(12) United States Patent
Van Rompaey et al.

(10) Patent No.: US 7,615,626 B2
(45) Date of Patent: Nov. 10, 2009

(54) METHODS, AGENTS, AND COMPOUND SCREENING ASSAYS FOR INDUCING DIFFERENTIATION OF UNDIFFERENTIATIED MAMMALIAN CELLS INTO OSTEOBLASTS

(75) Inventors: Luc Juliaan Corina Van Rompaey, Mechelen (BE); Peter Herwig Maria Tomme, Ghent (BE); Robin John Brown, Quarrendon Bucks (GB)

(73) Assignee: Galapagos N.V., Mechelen (BE)

( * ) Notice: Subject to any disclaimer, the term of this patent is extended or adjusted under 35 U.S.C. 154(b) by 146 days.

(21) Appl. No.: 11/551,744

(22) Filed: Oct. 23, 2006

(65) Prior Publication Data

US 2007/0184026 A1  Aug. 9, 2007

Related U.S. Application Data

(63) Continuation of application No. PCT/EP2005/051914, filed on Apr. 27, 2005.

(51) Int. Cl.
*C07H 21/02* (2006.01)
*C07H 21/04* (2006.01)
*C12Q 1/68* (2006.01)
*C12N 5/00* (2006.01)
*C12N 15/00* (2006.01)

(52) U.S. Cl. .................. 536/24.5; 435/6; 435/91.1; 435/320.1; 435/375; 536/23.1

(58) Field of Classification Search .............. 435/6, 435/91.1, 91.31, 375, 320.1; 514/44; 536/23.1, 536/24.5
See application file for complete search history.

(56) References Cited

U.S. PATENT DOCUMENTS

| 6,506,559 | B1 * | 1/2003 | Fire et al. .................... 435/6 |
| 6,828,473 | B2 * | 12/2004 | Burslem et al. ............. 800/18 |
| 7,332,317 | B2 * | 2/2008 | Omori et al. ................ 435/196 |
| 2003/0229002 | A1 * | 12/2003 | Burslem et al. ............. 514/1 |
| 2005/0266409 | A1 * | 12/2005 | Brown et al. ................ 435/6 |
| 2006/0166911 | A1 * | 7/2006 | Golz et al. .................. 514/44 |
| 2007/0031844 | A1 * | 2/2007 | Khvorova et al. ............ 435/6 |

FOREIGN PATENT DOCUMENTS

| WO | WO 03020931 | * | 3/2003 |
| WO | WO 03/070230 | * | 8/2003 |

OTHER PUBLICATIONS

Daluiski, A. et al., Bone Morphogenetic Protein-3 Is A Negative Regulator of Bone Density, Nature Genetics, Jan. 2001, vol. 27, pp. 84-88.
Nakashima, K. et al., Transcriptional Mechanisms in Osteoblast Differentiation and Bone Formation, Trends in Genetics, Department of Molecular Genetics, Aug. 2003 vol. 19, No. 8, pp. 458-466.
Reynolds, A. et al., Rational siRNA Design for RNA Interference, Nature Biotechnology, Mar. 2004, vol. 22, No. 3, pp. 326-330.
Thirunavukkarasu, K. et al., The Osteoblast-specific Transcription Factor Cbfa1 Contributes to the Expression of Osteoprotegerin, a Potent Inhibitor of Osteoclast Differentiation and Function, The Journal of Biological Chemistry, Aug. 2000, vol. 275, No. 33, pp. 25163-22172.
Yamada, T. et al., Regulation of osteoclast development by Notch signaling directed to osteoclast precursors and through stromal cells, The American Society of Hematology, Blood, Mar. 15, 2003, vol. 101, No. 6, pp. 2227-2234.

* cited by examiner

*Primary Examiner*—Jane Zara
(74) *Attorney, Agent, or Firm*—Martin Savitzky

(57) ABSTRACT

The present invention relates to methods, agents and compound screening assays for inducing differentiation of undifferentiated mammalian cells into osteoblasts. The invention thus provides a method, comprising contacting a compound with a polypeptide comprising an amino acid sequence selected from the group consisting of SEQ ID No: 194-309; and measuring a compound-polypeptide property related to the differentiation of said cells. The invention further relates to a bone formation enhancing pharmaceutical composition, and the use thereof in treating and/or preventing a disease involving a systemic or local decrease in mean bone density in a subject. Furthermore, the invention relates to a method for the in vitro production of bone tissue.

10 Claims, 9 Drawing Sheets

Figure 3

Figure 1:
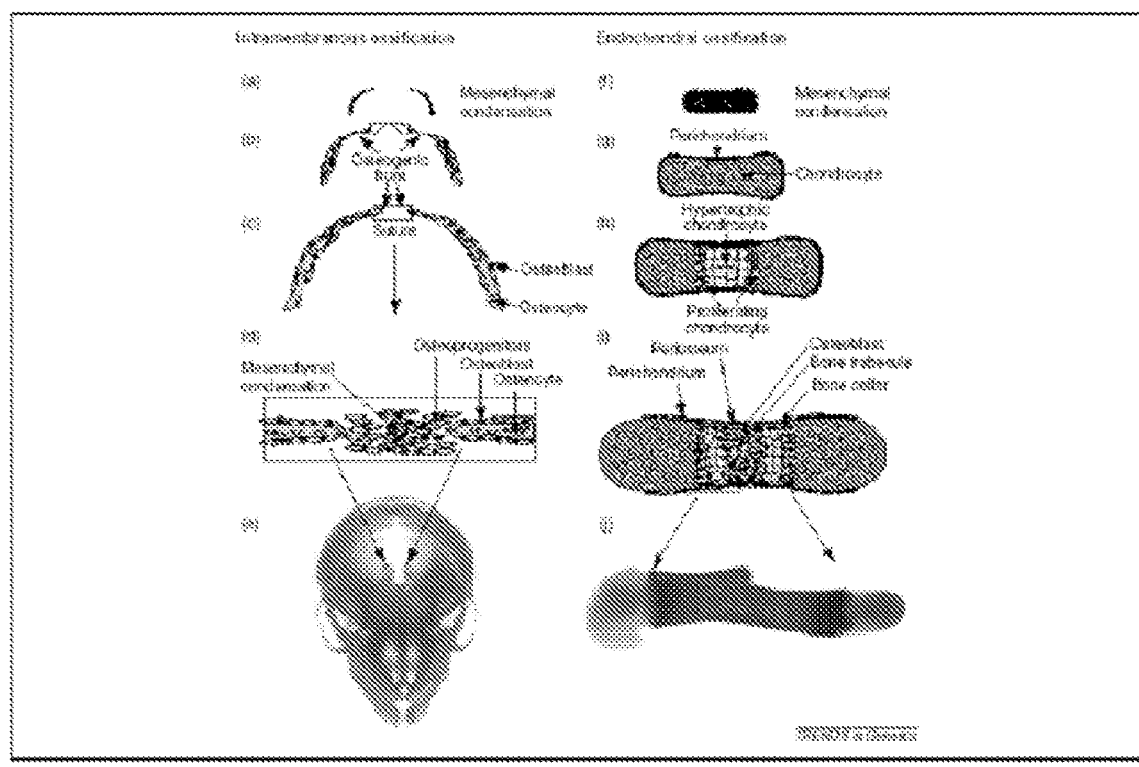

| 384 well plate prepared from 1 96 well plate and 1 plate with medium | | | | | | | | | | | | | | | | | | | | | | | |
|---|---|---|---|---|---|---|---|---|---|---|---|---|---|---|---|---|---|---|---|---|---|---|---|
| This plate is used as source plate for screening | | | | | | | | | | | | | | | | | | | | | | | |
| P1 | P1 | N1 | N1 | P2 | P2 | N2 | N2 | P3 | P3 | N3 | N3 | P1 | P1 | N1 | N1 | P2 | P2 | N2 | N2 | P3 | P3 | N3 | N3 |
| P1 |   | N1 |   | P2 |   | N2 |   | P3 |   | N3 |   | P1 |   | N1 |   | P2 |   | N2 |   | P3 |   | N3 |   |
| N1 | N1 | P2 | P2 | N2 | N2 | P3 | P3 | N3 | N3 | P1 | P1 | N1 | N1 | P2 | P2 | N2 | N2 | P3 | P3 | N3 | N3 | P1 | P1 |
| N1 |   | P2 |   | N2 |   | P3 |   | N3 |   | P1 |   | N1 |   | P2 |   | N2 |   | P3 |   | N3 |   | P1 |   |
| P2 | P2 | N2 | N2 | P3 | P3 | N3 | N3 | P1 | P1 | N1 | N1 | P2 | P2 | N2 | N2 | P3 | P3 | N3 | N3 | P1 | P1 | N1 | N1 |
| P2 |   | N2 |   | P3 |   | N3 |   | P1 |   | N1 |   | P2 |   | N2 |   | P3 |   | N3 |   | P1 |   | N1 |   |
| N2 | N2 | P3 | P3 | N3 | N3 | P1 | P1 | N1 | N1 | P2 | P2 | N2 | N2 | P3 | P3 | N3 | N3 | P1 | P1 | N1 | N1 | P2 | P2 |
| N2 |   | P3 |   | N3 |   | P1 |   | N1 |   | P2 |   | N2 |   | P3 |   | N3 |   | P1 |   | N1 |   | P2 |   |
| P3 | P3 | N3 | N3 | P1 | P1 | N1 | N1 | P2 | P2 | N2 | N2 | P3 | P3 | N3 | N3 | P1 | P1 | N1 | N1 | P2 | P2 | N2 | N2 |
| P3 |   | N3 |   | P1 |   | N1 |   | P2 |   | N2 |   | P3 |   | N3 |   | P1 |   | N1 |   | P2 |   | N2 |   |
| N3 | N3 | P1 | P1 | N1 | N1 | P2 | P2 | N2 | N2 | P3 | P3 | N3 | N3 | P1 | P1 | N1 | N1 | P2 | P2 | N2 | N2 | P3 | P3 |
| N3 |   | P1 |   | N1 |   | P2 |   | N2 |   | P3 |   | N3 |   | P1 |   | N1 |   | P2 |   | N2 |   | P3 |   |
| P1 | P1 | N1 | N1 | P2 | P2 | N2 | N2 | P3 | P3 | N3 | N3 | P1 | P1 | N1 | N1 | P2 | P2 | N2 | N2 | P3 | P3 | N3 | N3 |
| P1 |   | N1 |   | P2 |   | N2 |   | P3 |   | N3 |   | P1 |   | N1 |   | P2 |   | N2 |   | P3 |   | N3 |   |
| N1 | N1 | P2 | P2 | N2 | N2 | P3 | P3 | N3 | N3 | P1 | P1 | N1 | N1 | P2 | P2 | N2 | N2 | P3 | P3 | N3 | N3 | P1 | P1 |
| N1 |   | P2 |   | N2 |   | P3 |   | N3 |   | P1 |   | N1 |   | P2 |   | N2 |   | P3 |   | N3 |   | P1 |   |

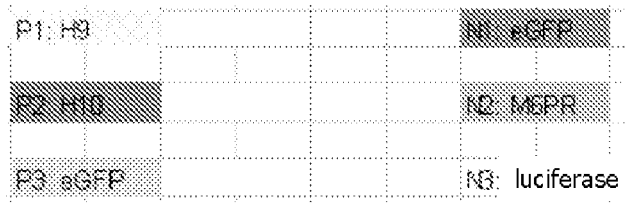

Figure 4

|   | Average | Standard deviation | cutoff (=mean (N1-3) + 3 x SD (N1-3)) | % positive |
|---|---|---|---|---|
| P1 | 20320 | 5018 |  | 98 |
| P2 | 21063 | 3138 |  | 100 |
| P3 | 2738 | 600 |  | 0 |
| N1 | 2940 | 1584 |  | 4 |
| N2 | 3565 | 1268 |  | 2 |
| N3 | 3385 | 962 |  | 0 |
| Blanco | 3707 | 1118 |  | 1 |
| All negatives | 3297 | 1314 | 7239 |  |

METHODS, AGENTS, AND COMPOUND SCREENING ASSAYS FOR INDUCING DIFFERENTIATION OF UNDIFFERENTIATIED MAMMALIAN CELLS INTO OSTEOBLASTS

CROSS-REFERENCE TO RELATED APPLICATIONS

This application is a continuation of PCT/EP2005/051914, filed Apr. 27, 2005, which claims priority to PCT/EP2004/004522, filed Apr. 27, 2004, both of which applications designate the United States, the disclosures of which are incorporated herein by reference.

FIELD OF THE INVENTION

This invention relates to the field of mammalian diseases involving a systemic or local decrease in mean bone density.

BACKGROUND OF THE INVENTION

Bone contains two distinct cell lineages, i.e. bone-forming cells (e.g. osteoblasts) and bone-resorbing cells (e.g. osteoclasts). Bone is a dynamic tissue that is continuously being destroyed (resorbed) and rebuilt, by an intricate interplay between these osteoblasts and osteoclasts. For osteoclasts, a cascade of transcription factors and growth factors involved in the progression from progenitor cell to functional osteoclast is well established. In contrast, little is known about the osteoblast lineage.

Osteoblasts derive from differentiated mesenchymal progenitor cells (MPCs). During the differentiation into osteoblasts bone alkaline phosphatase activity (BAP) becomes upregulated. Bone formation in vivo occurs through two distinct pathways during embryonic development: endochondral or intramembranous ossification (FIG. 1). As shown in this figure, mesenchymal progenitor or stem cells represent the starting points for both forms of bone formation. During intramembranous ossification, flat bones such as those of the skull or clavicles, are formed directly from condensations of mesenchymal cells. During the formation of long bones, such as limb bones, mesenchymal condensations first lead to a cartilage intermediate that is invaded during further development by endothelial cells, osteoclasts and mesenchymal cells that will differentiate into osteoblasts and osteocytes (Nakashima and de Crombrugghe, 2003).

A number of diseases are known which are caused by a disturbance of the fine-tuned balance between bone resorption and bone build-up, which skeletal diseases represent a large number of patients: hypercalcemia of malignancy, Paget's disease, inflammatory bone diseases like rheumatoid arthritis and periodontal disease, focal osteogenesis occurring during skeletal metastases, Crouzon's syndrome, rickets, opsismodysplasia, pycnodysostosis/Toulouse-Lautrec disease, osteogenesis imperfecta, and the single most important bone disease: osteoporosis.

Currently, osteoporosis affects 1 in 5 women over 50 and 1 in 20 men over 50. For these patients a number of treatments are available, which mostly tackle the net increase in bone resorption, i.e.:

hormone replacement therapy (HRT)
selective estrogen receptor modulators (SERMs)
bisphosphonates
calcitonin While these treatments slow down bone resorption, they do not abolish fracturing because the lost bone is not sufficiently replenished. Fracturing will be stopped when bone formation is sufficiently increased. Therefore, there is great interest in identifying osteogenic pathways that lend themselves to therapeutic intervention with bone anabolism as effect. Currently, only one bone anabolic therapy has reached the osteoporosis market: parathyroid hormone (PTH) 1-34. PTH displays bone anabolic effects when administered intermittently. The treatment with PTH is, however, very cumbersome because this biopharmaceutical needs to be injected daily by the patient. In addition, tumor formation has been observed when treating animals at high doses. Also, it is a very expensive treatment.

Another class of bone anabolics, bone morphogenetic proteins (BMPs), have been approved but only for niche markets, as there are disadvantages to their use as therapeutic agents to enhance bone healing. Receptors for the bone morphogenetic proteins have been identified in many tissues, and the BMPs themselves are expressed in a large variety of tissues in specific temporal and spatial patterns. This suggests that BMPs may have effects on many tissues other than bone, potentially limiting their usefulness as therapeutic agents when administered systemically.

Accordingly, there is a continuing need for novel treatment strategies and compounds (in particular anabolics) that obviate one or more of the drawbacks of the currently available treatment strategies.

SUMMARY OF THE INVENTION

One aspect of the present invention relates to a method for identifying a compound that induces differentiation of undifferentiated mammalian cells into osteoblasts, comprising contacting a compound with a polypeptide comprising an amino acid sequence selected from the group consisting of SEQ ID No: 194-309; and measuring a compound-polypeptide property related to the differentiation of said cells.

Another aspect of the invention relates to an agent for inducing the differentiation of undifferentiated mammalian cells into osteoblasts, selected from the group consisting of an antisense polynucleotide, a ribozyme and a small interfering RNA (siRNA), wherein said agent comprises a nucleic acid sequence complementary to, or engineered from, a naturally occurring polynucleotide sequence encoding a polypeptide comprising an amino acid sequence selected from the group consisting of SEQ ID No: 194-309.

A further aspect of the invention relates to a bone formation enhancing pharmaceutical composition comprising a therapeutically effective amount of the agent in admixture with a pharmaceutically acceptable carrier.

Another aspect of the invention relates to a method for treating and/or preventing a disease involving a systemic or local decrease in mean bone density in a subject, comprising administering to said subject said bone formation enhancing pharmaceutical composition.

A further aspect of the present invention relates to the use of the above-described agents in the manufacture of a medicament for the treatment and/or prevention of a disease involving a systemic or local decrease in mean bone density.

Another aspect of the invention relates to a method for the in vitro production of bone tissue, comprising the steps of contacting undifferentiated mammalian cells with a polynucleotide sequence comprising a sequence selected from the group consisting of SEQ ID No: 1-77 for a time sufficient to differentiate the undifferentiated cells into osteoblasts, thereby producing a continuous bone matrix.

DETAILED DESCRIPTION

Definitions:

The term "carrier" means a non-toxic material used in the formulation of pharmaceutical compositions to provide a medium, bulk and/or useable form to a pharmaceutical composition. A carrier may comprise one or more of such materials such as an excipient, stabilizer, or an aqueous pH buffered solution. Examples of physiologically acceptable carriers include aqueous or solid buffer ingredients including phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counter ions such as sodium; and/or nonionic surfactants such as TWEEN.™, polyethylene glycol (PEG), and PLURONICS.™.

The term "compound" is used herein in the context of a "test compound" or a "drug candidate compound" described in connection with the assays of the present invention. As such, these compounds comprise organic or inorganic compounds, derived synthetically or from natural sources. The compounds include inorganic or organic compounds such as polynucleotides, lipids or hormone analogs that are characterized by relatively low molecular weights. Other biopolymeric organic test compounds include peptides comprising from about 2 to about 40 amino acids and larger polypeptides comprising from about 40 to about 500 amino acids, such as antibodies or antibody conjugates.

The term "contact" or "contacting" means bringing at least two moieties together, whether in an in vitro system or an in vivo system.

The term "condition" or "disease" means the overt presentation of symptoms (i.e., illness) or the manifestation of abnormal clinical indicators (e.g., biochemical indicators). Alternatively, the term "disease" refers to a genetic or environmental risk of or propensity for developing such symptoms or abnormal clinical indicators.

The term "endogenous" shall mean a material that a mammal naturally produces. In contrast, the term non-endogenous in this context shall mean that which is not naturally produced by a mammal (for example, and not limitation, a human) or a virus.

The term "expression" comprises both endogenous expression and overexpression by transduction.

The term "expressible nucleic acid" means a nucleic acid coding for a proteinaceous molecule, an RNA molecule, or a DNA molecule.

The term "hybridization" means any process by which a strand of nucleic acid binds with a complementary strand through base pairing. The term "hybridization complex" refers to a complex formed between two nucleic acid sequences by virtue of the formation of hydrogen bonds between complementary bases. A hybridization complex may be formed in solution (e.g., C.sub.0t or R.sub.0t analysis) or formed between one nucleic acid sequence present in solution and another nucleic acid sequence immobilized on a solid support (e.g., paper, membranes, filters, chips, pins or glass slides, or any other appropriate substrate to which cells or their nucleic acids have been fixed). The term "stringent conditions" refers to conditions that permit hybridization between polynucleotides and the claimed polynucleotides. Stringent conditions can be defined by salt concentration, the concentration of organic solvent, e.g., formamide, temperature, and other conditions well known in the art. In particular, reducing the concentration of salt, increasing the concentration of formamide, or raising the hybridization temperature can increase stringency.

The term "inhibit" or "inhibiting", in relationship to the term "response" means that a response is decreased or prevented in the presence of a compound as opposed to in the absence of the compound.

The term "pharmaceutically acceptable prodrugs" as used herein means the prodrugs of the compounds useful in the present invention, which are, within the scope of sound medical judgment, suitable for use in contact with the tissues of patients with undue toxicity, irritation, allergic response commensurate with a reasonable benefit/risk ratio, and effective for their intended use of the compounds of the invention. The term "prodrug" means a compound that is transformed in vivo to yield an effective compound useful in the present invention or a pharmaceutically acceptable salt, hydrate or solvate thereof. The transformation may occur by various mechanisms, such as through hydrolysis in blood. The compounds bearing metabolically cleavable groups have the advantage that they may exhibit improved bioavailability as a result of enhanced solubility and/or rate of absorption conferred upon the parent compound by virtue of the presence of the metabolically cleavable group, thus, such compounds act as prodrugs. A thorough discussion is provided in Design of Prodrugs, H. Bundgaard, ed., Elsevier (1985); Methods in Enzymology; K. Widder et al, Ed., Academic Press, 42, 309-396 (1985); A Textbook of Drug Design and Development, Krogsgaard-Larsen and H. Bandaged, ed., Chapter 5; "Design and Applications of Prodrugs" 113-191 (1991); Advanced Drug Delivery Reviews, H. Bundgard, 8, 1-38, (1992); J. Pharm. Sci., 77, 285 (1988); Chem. Pharm. Bull., N. Nakeya et al, 32, 692 (1984); Pro-drugs as Novel Delivery Systems, T. Higuchi and V. Stella, 14 A.C.S. Symposium Series, and Bioreversible Carriers in Drug Design, E. B. Roche, ed., American Pharmaceutical Association and Pergamon Press, 1987, which are incorporated herein by reference. An example of the prodrugs is an ester prodrug. "Ester prodrug" means a compound that is convertible in vivo by metabolic means (e.g., by hydrolysis) to an inhibitor compound according to the present invention. For example an ester prodrug of a compound containing a carboxy group may be convertible by hydrolysis in vivo to the corresponding carboxy group.

The term "pharmaceutically acceptable salts" refers to the non-toxic, inorganic and organic acid addition salts, and base addition salts, of compounds of the present invention. These salts can be prepared in situ during the final isolation and purification of compounds useful in the present invention.

The term "polynucleotide" means a polynucleic acid, in single or double stranded form, and in the sense or antisense orientation, complementary polynucleic acids that hybridize to a particular polynucleic acid under stringent conditions, and polynucleotides that are homologous in at least about 60 percent of its base pairs, and more preferably 70 percent of its base pairs are in common, most preferably 90 percent, and in a special embodiment 100 percent of its base pairs. The polynucleotides include polyribonucleic acids, polydeoxyribonucleic acids, and synthetic analogues thereof. The polynucleotides are described by sequences that vary in length, that range from about 10 to about 5000 bases, preferably about 100 to about 4000 bases, more preferably about 250 to about 2500 bases. A preferred polynucleotide embodiment comprises from about 10 to about 30 bases in length. A special embodiment of polynucleotide is the polyribonucleotide of from about 10 to about 22 nucleotides, more commonly described as small interfering RNAs (siRNAs). Another special embodiment are nucleic acids with modified backbones such as peptide nucleic acid (PNA), polysiloxane, and 2'-O-(2-methoxy)ethylphosphorothioate, or including non-naturally occurring nucleic acid residues, or one or more nucleic acid substituents, such as methyl-, thio-, sulphate, benzoyl-, phenyl-, amino-, propyl-, chloro-, and methanocarbanucleosides, or a reporter molecule to facilitate its detection.

The term "polypeptide" relates to proteins, proteinaceous molecules, fractions of proteins peptides and oligopeptides.

The term "solvate" means a physical association of a compound useful in this invention with one or more solvent molecules. This physical association includes hydrogen bonding. In certain instances the solvate will be capable of isolation, for example when one or more solvent molecules are incorporated in the crystal lattice of the crystalline solid. "Solvate" encompasses both solution-phase and isolable solvates. Representative solvates include hydrates, ethanolates and methanolates.

The term "subject" includes humans and other mammals.

The term "effective amount" or "therapeutically effective amount" means that amount of a compound or agent that will elicit the biological or medical response of a subject that is being sought by a medical doctor or other clinician. In particular, with regard to treating a bone-related disorder, the term "effective amount" is intended to mean that amount of a compound or agent that will elicit the biological or medical response of a subject that is being sought by a medical doctor or other clinician. In particular, with regard to treating a condition involving a systemic of local decrease in mean bone density, the term "effective amount" is intended to mean that effective amount of an compound or agent that will bring about a biologically meaningful increase in mean bone density.

The term "treating" means an intervention performed with the intention of preventing the development or altering the pathology of, and thereby alleviating a disorder, disease or condition, including one or more symptoms of such disorder or condition. Accordingly, "treating" refers to both therapeutic treatment and prophylactic or preventative measures. Those in need of treating include those already with the disorder as well as those in which the disorder is to be prevented. The related term "treatment," as used herein, refers to the act of treating a disorder, symptom, disease or condition, as the term "treating" is defined above.

"Undifferentiated mammalian cells" are pluripotent cells which are in an early stage of specialization, i.e. cells which do not yet have their final function and can be induced to form almost any given cell type. In particular, these are cells which have not yet differentiated to the specific bone cells osteoblasts or osteoclasts. Such pluropotent cells are especially blood cells and cells present in bone marrow, as well as cells derived from adipose tissue. In addition, cells which can be differentiated into mesenchymal precursor cells are contemplated in the present invention, such as, for example, totipotent stem cells such as embryonic stem cells.

One aspect of the present invention is related to a method for identifying a compound that induces differentiation of undifferentiated mammalian cells into osteoblasts, comprising contacting a compound with a polypeptide comprising an amino acid sequence selected from the group consisting of SEQ ID No: 194-309; and measuring a compound-polypeptide property related to the differentiation of said cells. The "compound-polypeptide property" is a measurable phenomenon chosen by the person of ordinary skill in the art. The measurable property may e.g. be the binding affinity for a peptide domain of the polypeptide or the level of any one of a number of biochemical marker levels of osteoblast differentiation. Osteoblast differentiation can e.g. be measured by measuring the level of enzymes that are induced during the differentiation process, such as alkaline phosphatase, type-1 collagen, osteocalcin and osteopontin. The alkaline phosphatase activity can be measured by adding methylumbelliferyl heptaphosphate (MUP) solution (Sigma) to the cells. The fluorescence generated upon cleavage of the MUP substrate by the AP activity is measured on a fluorescence plate reader (Fluostar, BMG).

In a preferred embodiment of the invention, the polypeptide comprises an amino acid sequence selected from the group consisting of SEQ ID No: 199, 230, 237, 262 and 281 (Table 2B).

Depending on the choice of the skilled artisan, the present assay method may be designed to function as a series of measurements, each of which is designed to determine whether the drug candidate compound is indeed acting on the polypeptide to thereby induce the differentiation of undifferentiated cells into osteoblasts. For example, an assay designed to determine the binding affinity of a compound to the polypeptide, or fragment thereof, may be necessary, but not sufficient, to ascertain whether the test compound would be useful for increasing mean bone density when administered to a subject. Nonetheless, such binding information would be useful in identifying a set of test compounds for use in an assay that would measure a different property, further down the biochemical pathway, such as bone mineralization, assayed by measuring the amount of deposited calcium. Such second assay may be designed to confirm that the test compound, having binding affinity for the polypeptide, actually induces the differentiation of undifferentiated cells into osteoblasts. Suitable controls should always be in place to insure against false positive readings.

The order of taking these measurements is not believed to be critical to the practice of the present invention, which may be practiced in any order. For example, one may first perform a screening assay of a set of compounds for which no information is known respecting the compounds' binding affinity for the polypeptide. Alternatively, one may screen a set of compounds identified as having binding affinity for a polypeptide domain, or a class of compounds identified as being an inhibitor of the polypeptide. However, for the present assay to be meaningful to the ultimate use of the drug candidate compounds, a measurement of bone alkaline phosphatase levels or bone mineralization is necessary. Validation studies including controls, and measurements of binding affinity to the polypeptides of the invention are nonetheless useful in identifying a compound useful in any therapeutic or diagnostic application.

The present assay method may be practiced in a cell-free system in vitro, using one or more of the polypeptides, or fragments thereof. The binding affinity of the compound with the polypeptide can be measured by methods known in the art, such as using surface plasmon resonance biosensors (Biacore), by saturation binding analysis with a labeled compound (e.g. Scatchard and Lindmo analysis), by differential UV spectrophotometer, fluorescence polarization assay, Fluorometric Imaging Plate Reader (FLIPR®) system, Fluorescence resonance energy transfer, and Bioluminescence resonance energy transfer. The binding affinity of compounds can also be expressed in dissociation constant (Kd) or as IC50 or EC50. The IC50 represents the concentration of a compound that is required for 50% inhibition of binding of another ligand to the polypeptide. The EC50 represents the concentration required for obtaining 50% of the maximum effect in any assay that measures receptor function. The dissociation constant, Kd, is a measure of how well a ligand binds to the polypeptide, it is equivalent to the ligand concentration required to saturate exactly half of the binding-sites on the polypeptide. Compounds with a high affinity binding have low Kd, IC50 and EC50 values, i.e. in the range of 100 nM to 1 pM; a moderate to low affinity binding relates to a high Kd, IC50 and EC50 values, i.e. in the micromolar range.

The present assay method may also be practiced in a cellular assay. A host cell expressing the polypeptide can be a cell with endogenous expression or a cell over-expressing the polypeptide by transduction. When the endogenous expression of the polypeptide is not sufficient to determine a baseline that can easily be measured, one may use using host cells that over-express the polypeptide. In such cellular assay, the biological activity of the polypeptide may be measured by following the production of bone alkaline phosphatase (BAP) or bone mineralization.

The present invention further relates to a method for identifying a compound that induces differentiation of undifferentiated mammalian cells into osteoblasts, comprising:

(a) contacting a compound with a polypeptide comprising an amino acid sequence selected from the group consisting of SEQ ID NO: 194-309;
(b) determining the binding affinity of the compound to the polypeptide;
(c) contacting a population of mammalian cells expressing said polypeptide with the compound that exhibits a binding affinity of at least 10 micromolar; and
(d) identifying the compound that induces the differentiation of said undifferentiated cells.

For high-throughput purposes, libraries of compounds may be used such as antibody fragment libraries, peptide phage display libraries, peptide libraries (e.g. LOPAP™, Sigma Aldrich), lipid libraries (BioMol), synthetic compound libraries (e.g. LOPAC™, Sigma Aldrich) or natural compound libraries (Specs, TimTec).

Preferred drug candidate compounds are low molecular weight compounds. Low molecular weight compounds, i.e. with a molecular weight of 500 Dalton or less, are likely to have good absorption and permeation in biological systems and are consequently more likely to be successful drug candidates than compounds with a molecular weight above 500 Dalton. Peptides comprise another preferred class of drug candidate compounds. Peptides may be excellent drug candidates and there are multiple examples of commercially valuable peptides such as fertility hormones and platelet aggregation inhibitors. Natural compounds are another preferred class of drug candidate compound. Such compounds are found in and extracted from natural sources, and which may thereafter be synthesized. The lipids are another preferred class of drug candidate compound.

Another preferred class of drug candidate compounds is an antibody. The present invention also provides antibodies directed against the extracellular domains of the polypepides of the invention. These antibodies should specifically bind to one or more of the extra-cellular domains of the polypeptides, or as described further below, engineered to be endogenously produced to bind to an intra-cellular polypeptide domain. These antibodies may be monoclonal antibodies or polyclonal antibodies. The present invention includes chimeric, single chain, and humanized antibodies, as well as FAb fragments and the products of a FAb expression library, and Fv fragments and the products of an Fv expression library.

In certain embodiments, polyclonal antibodies may be used in the practice of the invention. The skilled artisan knows methods of preparing polyclonal antibodies. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. Antibodies may also be generated against the intact protein or polypeptide, or against a fragment such as its extracellular domain peptides, derivatives including conjugates, or other epitope of the protein or polypeptide, such as the polypeptide embedded in a cellular membrane, or a library of antibody variable regions, such as a phage display library.

It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants that may be employed include Freund's complete adjuvant and MPL-TDM adjuvant (monophosphoryl Lipid A, synthetic trehalose dicorynomycolate). One skilled in the art without undue experimentation may select the immunization protocol.

In some embodiments, the antibodies may be monoclonal antibodies. Monoclonal antibodies may be prepared using methods known in the art. The monoclonal antibodies of the present invention may be "humanized" to prevent the host from mounting an immune response to the antibodies. A "humanized antibody" is one in which the complementarity determining regions (CDRs) and/or other portions of the light and/or heavy variable domain framework are derived from a non-human immunoglobulin, but the remaining portions of the molecule are derived from one or more human immunoglobulins. Humanized antibodies also include antibodies characterized by a humanized heavy chain associated with a donor or acceptor unmodified light chain or a chimeric light chain, or vice versa. The humanization of antibodies may be accomplished by methods known in the art (see, e.g. Mark and Padlan, (1994) "Chapter 4. Humanization of Monoclonal Antibodies", The Handbook of Experimental Pharmacology Vol. 113, Springer-Verlag, New York). Transgenic animals may be used to express humanized antibodies.

Human antibodies can also be produced using various techniques known in the art, including phage display libraries (Hoogenboom and Winter, (1991) J. Mol. Biol. 227:381-8; Marks et al. (1991). J. Mol. Biol. 222:581-97). The techniques of Cole, et al. and Boerner, et al. are also available for the preparation of human monoclonal antibodies (Cole, et al. (1985) Monoclonal Antibodies and Cancer Therapy, Alan R. Liss, p. 77; Boerner, et al (1991). J. Immunol., 147(1):86-95).

Techniques known in the art for the production of single chain antibodies can be adapted to produce single chain antibodies to the polypeptides and proteins of the present invention. The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain cross-linking. Alternatively; the relevant cysteine residues are substituted with another amino acid residue or are deleted so as to prevent cross-linking.

Bispecific antibodies are monoclonal, preferably human or humanized, antibodies that have binding specificities for at least two different antigens and preferably for a cell-surface protein or receptor or receptor subunit.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, (1983) Nature 305:537-9). Because of the random assortment of immunoglobulin heavy and light chains, these hybridomas (quadromas) produce a potential mixture of ten different antibody molecules, of which only one has the correct bispecific structure. Affinity chromatography steps usually accomplish the purification of the correct molecule. Similar procedures are disclosed in Trauneeker, et al. (1991) EMBO J. 10:3655-9.

According to another preferred embodiment, the assay method comprises using a drug candidate compound identified as having a binding affinity for a polypeptide comprising an amino acid sequence selected from the group consisting of 194-309.

The invention further relates to an agent for inducing the differentiation of undifferentiated mammalian cells into osteoblasts, selected from the group consisting of an antisense polynucleotide, a ribozyme, and a small interfering RNA (siRNA), wherein said agent comprises a nucleic acid sequence complementary to, or engineered from, a naturally-occurring polynucleotide sequence encoding a polypeptide comprising an amino acid sequence selected from the group consisting of SEQ ID NO: 194-309. In a preferred embodiment, the agent is selected from the group consisting of an antisense polynucleotide, a ribozyme, and a small interfering RNA (siRNA), wherein said agent comprises a nucleic acid sequence complementary to, or engineered from, a naturally-occurring polynucleotide sequence encoding a polypeptide comprising an amino acid sequence selected from the group consisting of SEQ ID NO: 199, 230, 237, 262 and 181.

One embodiment of the agent is a nucleic acid that is antisense to a nucleic acid comprising SEQ ID NO: 83-193. Preferably, the agent is a nucleic acid that is antisense to a nucleic acid comprising SEQ ID No:83, 114, 121, 146 and 165. For example, an antisense nucleic acid (e.g. DNA) may be introduced into cells in vitro, or administered to a subject in vivo, as gene therapy to inhibit cellular expression of nucleic acids comprising SEQ ID NO: 78-193, preferably comprising SEQ ID NO 199, 230, 237, 262 and 281. Antisense oligonucleotides preferably comprise a sequence containing from about 17 to about 100 nucleotides and more preferably the antisense oligonucleotides comprise from about 18 to about 30 nucleotides. Antisense nucleic acids may be prepared from about 10 to about 30 contiguous nucleotides selected from the sequences of SEQ ID NO: 78-193, expressed in the opposite orientation.

The antisense nucleic acids are preferably oligonucleotides and may consist entirely of deoxyribo-nucleotides, modified deoxyribonucleotides, or some combination of both. The antisense nucleic acids can be synthetic oligonucleotides. The oligonucleotides may be chemically modified, if desired, to improve stability and/or selectivity. Since oligonucleotides are susceptible to degradation by intracellular nucleases, the modifications can include, for example, the use of a sulfur group to replace the free oxygen of the phosphodiester bond. This modification is called a phosphorothioate linkage. Phosphorothioate antisense oligonucleotides are water soluble, polyanionic, and resistant to endogenous nucleases. In addition, when a phosphorothioate antisense oligonucleotide hybridizes to its target site, the RNA-DNA duplex activates the endogenous enzyme ribonuclease (RNase) H, which cleaves the mRNA component of the hybrid molecule.

In addition, antisense oligonucleotides with phosphoramidite and polyamide (peptide) linkages can be synthesized. These molecules should be very resistant to nuclease degradation. Furthermore, chemical groups can be added to the 2' carbon of the sugar moiety and the 5 carbon (C-5) of pyrimidines to enhance stability and facilitate the binding of the antisense oligonucleotide to its target site. Modifications may include 2'-deoxy, O-pentoxy, O-propoxy, O-methoxy, fluoro, methoxyethoxy phosphorothioates, modified bases, as well as other modifications known to those of skill in the art.

Another type of expression-inhibitory agent that reduces the levels of the polypeptides of the invention is ribozymes. Ribozymes are catalytic RNA molecules (RNA enzymes) that have separate catalytic and substrate binding domains. The substrate binding sequence combines by nucleotide complementarity and, possibly, non-hydrogen bond interactions with its target sequence. The catalytic portion cleaves the target RNA at a specific site. The substrate domain of a ribozyme can be engineered to direct it to a specified mRNA sequence. The ribozyme recognizes and then binds a target mRNA through complementary base pairing. Once it is bound to the correct target site, the ribozyme acts enzymatically to cut the target mRNA. Cleavage of the mRNA by a ribozyme destroys its ability to direct synthesis of the corresponding polypeptide. Once the ribozyme has cleaved its target sequence, it is released and can repeatedly bind and cleave at other mRNAs.

Ribozyme forms include a hammerhead motif, a hairpin motif, a hepatitis delta virus, group I intron or RNaseP RNA (in association with an RNA guide sequence) motif or Neurospora VS RNA motif. Ribozymes possessing a hammerhead or hairpin structure are readily prepared since these catalytic RNA molecules can be expressed within cells from eukaryotic promoters (Chen, et al. (1992) Nucleic Acids Res. 20:4581-9). A ribozyme of the present invention can be expressed in eukaryotic cells from the appropriate DNA vector. If desired, the activity of the ribozyme may be augmented by its release from the primary transcript by a second ribozyme (Ventura, et al. (1993) Nucleic Acids Res. 21:3249-55).

Ribozymes may be chemically synthesized by combining an oligodeoxyribonucleotide with a ribozyme catalytic domain (20 nucleotides) flanked by sequences that hybridize to the target mRNA after transcription. The oligodeoxyribonucleotide is amplified by using the substrate binding sequences as primers. The amplification product is cloned into a eukaryotic expression vector.

Ribozymes are expressed from transcription units inserted into DNA, RNA, or viral vectors. Transcription of the ribozyme sequences are driven from a promoter for eukaryotic RNA polymerase I (pol (I), RNA polymerase II (pol II), or RNA polymerase III (pol III). Transcripts from pol II or pol III promoters will be expressed at high levels in all cells; the levels of a given pol II promoter in a given cell type will depend on nearby gene regulatory sequences. Prokaryotic RNA polymerase promoters are also used, providing that the prokaryotic RNA polymerase enzyme is expressed in the appropriate cells (Gao and Huang, (1993) Nucleic Acids Res. 21:2867-72). It has been demonstrated that ribozymes expressed from these promoters can function in mammalian cells (Kashani-Sabet, et al. (1992) Antisense Res. Dev. 2:3-15).

A particularly preferred inhibitory agent is a small interfering RNA (siRNA). SiRNAs mediate the post-transcriptional process of gene silencing by double stranded RNA (dsRNA) that is homologous in sequence to the silenced RNA. SiRNA according to the present invention comprises a sense strand of 17-25 nucleotides complementary or homologous to a contiguous 17-25 nucleotide sequence selected from the group of sequences described in SEQ ID NO: 78-193, preferably from the group of sequences described in SEQ ID No: 83, 114, 121, 146 and 165 and an antisense strand of 17-23 nucleotides complementary to the sense strand. The most preferred siRNA comprises sense and anti-sense strands that are 100 percent complementary to each other and the target polynucleotide sequence. Preferably the siRNA further comprises a loop region linking the sense and the antisense strand.

A self-complementing single stranded siRNA molecule polynucleotide according to the present invention comprises a sense portion and an antisense portion connected by a loop region linker. Preferably, the loop region sequence is 4-30 nucleotides long, more preferably 5-15 nucleotides long and most preferably 8 nucleotides long. In a most preferred embodiment the linker sequence is GTTTGCTATAACas identified by SEQ ID No. 310. Self-complementary single stranded siRNAs form hairpin loops and are more stable than ordinary dsRNA. In addition, they are more easily produced from vectors.

Analogous to antisense RNA, the siRNA can be modified to confirm resistance to nucleolytic degradation, or to enhance activity, or to enhance cellular distribution, or to enhance cellular uptake, such modifications may consist of modified internucleoside linkages, modified nucleic acid bases, modified sugars and/or chemical linkage the SiRNA to one or more moieties or conjugates. The nucleotide sequences are selected according to siRNA designing rules that give an improved reduction of the target sequences compared to nucleotide sequences that do not comply with these siRNA designing rules (For a discussion of these rules and examples of the preparation of siRNA, WO2004094636, published Nov. 4, 2004, and UA20030198627, are hereby incorporated by reference.

The present invention also relates to compositions, and methods using said compositions, comprising a DNA expression vector capable of expressing a polynucleotide capable of inducing differentiation of undifferentiated cells into osteoblasts and described hereinabove as an expression inhibition agent.

The polynucleotide expressing the expression-inhibiting agent is preferably included within a vector. The polynucleic acid is operably linked to signals enabling expression of the nucleic acid sequence and is introduced into a cell utilizing, preferably, recombinant vector constructs, which will express the antisense nucleic acid once the vector is introduced into the cell. A variety of viral-based systems are available, including adenoviral, retroviral, adeno-associated viral, lentiviral, herpes simplex viral or a sendaviral vector systems, and all may be used to introduce and express polynucleotide sequence for the expression-inhibiting agents in target cells.

Preferably, the viral vectors used in the methods of the present invention are replication defective. Such replication defective vectors will usually pack at least one region that is necessary for the replication of the virus in the infected cell. These regions can either be eliminated (in whole or in part), or be rendered non-functional by any technique known to a person skilled in the art. These techniques include the total removal, substitution, partial deletion or addition of one or more bases to an essential (for replication) region. Such techniques may be performed in vitro (on the isolated DNA) or in situ, using the techniques of genetic manipulation or by treatment with mutagenic agents. Preferably, the replication defective virus retains the sequences of its genome, which are necessary for encapsidating, the viral particles.

In a preferred embodiment, the viral element is derived from an adenovirus. Preferably, the vehicle includes an adenoviral vector packaged into an adenoviral capsid, or a functional part, derivative, and/or analogue thereof. Adenovirus biology is also comparatively well known on the molecular level. Many tools for adenoviral vectors have been and continue to be developed, thus making an adenoviral capsid a preferred vehicle for incorporating in a library of the invention. An adenovirus is capable of infecting a wide variety of cells. However, different adenoviral serotypes have different preferences for cells. To combine and widen the target cell population that an adenoviral capsid of the invention can enter in a preferred embodiment, the vehicle includes adenoviral fiber proteins from at least two adenoviruses.

In a preferred embodiment, the nucleic acid derived from an adenovirus includes the nucleic acid encoding an adenoviral late protein or a functional part, derivative, and/or analogue thereof. An adenoviral late protein, for instance an adenoviral fiber protein, may be favorably used to target the vehicle to a certain cell or to induce enhanced delivery of the vehicle to the cell. Preferably, the nucleic acid derived from an adenovirus encodes for essentially all adenoviral late proteins, enabling the formation of entire adenoviral capsids or functional parts, analogues, and/or derivatives thereof. Preferably, the nucleic acid derived from an adenovirus includes the nucleic acid encoding adenovirus E2A or a functional part, derivative, and/or analogue thereof. Preferably, the nucleic acid derived from an adenovirus includes the nucleic acid encoding at least one E4-region protein or a functional part, derivative, and/or analogue thereof, which facilitates, at least in part, replication of an adenoviral derived nucleic acid in a cell. The adenoviral vectors used in the examples of this application are exemplary of the vectors useful in the present method of treatment invention.

Certain embodiments of the present invention use retroviral vector systems. Retroviruses are integrating viruses that infect dividing cells, and their construction is known in the art. Retroviral vectors can be constructed from different types of retrovirus, such as, MoMuLV ("murine Moloney leukemia virus" MSV ("murine Moloney sarcoma virus"), HaSV ("Harvey sarcoma virus"); SNV ("spleen necrosis virus"); RSV ("Rous sarcoma virus") and Friend virus. Lentiviral vector systems may also be used in the practice of the present invention. Retroviral systems and herpes virus system may be preferred vehicles for transfection of neuronal cells.

In other embodiments of the present invention, adeno-associated viruses ("AAV") are utilized. The AAV viruses are DNA viruses of relatively small size that integrate, in a stable and site-specific manner, into the genome of the infected cells. They are able to infect a wide spectrum of cells without inducing any effects on cellular growth, morphology or differentiation, and they do not appear to be involved in human pathologies.

In the vector construction, the polynucleotide agents of the present invention may be linked to one or more regulatory regions. Selection of the appropriate regulatory region or regions is a routine matter, within the level of ordinary skill in the art. Regulatory regions include promoters, and may include enhancers, suppressors, etc.

Promoters that may be used in the expression vectors of the present invention include both constitutive promoters and regulated (inducible) promoters. The promoters may be prokaryotic or eukaryotic depending on the host. Among the prokaryotic (including bacteriophage) promoters useful for practice of this invention are lac, lacZ, T3, T7, lambda P.sub.r, P.sub.1, and trp promoters. Among the eukaryotic (including viral) promoters useful for practice of this invention are ubiquitous promoters (e.g. HPRT, vimentin, actin, tubulin), intermediate filament promoters (e.g. desmin, neurofilaments, keratin, GFAP), therapeutic gene promoters (e.g. MDR type, CFTR, factor VIII), tissue-specific promoters (e.g. actin promoter in smooth muscle cells, or Flt and Flk promoters active in endothelial cells), including animal transcriptional control regions, which exhibit tissue specificity and have been utilized in transgenic animals: elastase I gene control region which is active in pancreatic acinar cells (Swift, et al. (1984) Cell 38:639-46; Ornitz, et al. (1986) Cold Spring Harbor Symp. Quant. Biol. 50:399-409; MacDonald, (1987) Hepatology 7:425-515); insulin gene control region which is active in pancreatic beta cells (Hanahan, (1985) Nature 315:115-22), immunoglobulin gene control region which is active in lymphoid cells (Grosschedl, et al. (1984) Cell 38:647-58; Adames, et al. (1985) Nature 318:533-8; Alexander, et al. (1987) Mol. Cell. Biol. 7:1436-44), mouse mammary tumor virus control region which is active in testicular, breast, lymphoid and mast cells (Leder, et al. (1986) Cell 45:485-95), albumin gene control region which is active in liver (Pinkert, et al. (1987) Genes and Devel. 1:268-76), alpha-fetoprotein gene control region which is active in liver (Krumlauf, et al. (1985) Mol. Cell. Biol., 5:1639-48; Hammer, et al. (1987) Science 235:53-8), alpha 1-antitrypsin gene control region which is active in the liver (Kelsey, et al. (1987) Genes and Devel., 1: 161-71), beta-globin gene control region which is active in myeloid cells (Mogram, et al. (1985) Nature 315: 338-40; Kollias, et al. (1986) Cell 46:89-94), myelin basic protein gene control region which is active in oligodendrocyte cells in the brain (Readhead, et al. (1987) Cell 48:703-12), myosin light chain-2 gene control region which is active in skeletal muscle (Sani, (1985) Nature 314.283-6), and gonadotropic releasing hormone gene control region which is active in the hypothalamus (Mason, et al. (1986) Science 234:1372-8).

Other promoters which may be used in the practice of the invention include promoters which are preferentially activated in dividing cells, promoters which respond to a stimulus (e.g. steroid hormone receptor, retinoic acid receptor), tetracycline-regulated transcriptional modulators, cytomegalovirus immediate-early, retroviral LTR, metallothionein, SV-40, E1a, and MLP promoters.

Additional vector systems include the non-viral systems that facilitate introduction of polynucleotide agents into a patient. For example, a DNA vector encoding a desired sequence can be introduced in vivo by lipofection. Synthetic cationic lipids designed to limit the difficulties encountered with liposome-mediated transfection can be used to prepare liposomes for in vivo transfection of a gene encoding a marker (Felgner, et. al. (1987) Proc. Natl. Acad. Sci. USA 84:7413-7); see Mackey, et al. (1988) Proc. Natl. Acad. Sci. USA 85:8027-31; Ulmer, et al. (1993) Science 259:1745-8). The use of cationic lipids may promote encapsulation of negatively charged nucleic acids, and also promote fusion with negatively charged cell membranes (Felgner and Ringold, (1989) Nature 337:387-8). Particularly useful lipid compounds and compositions for transfer of nucleic acids are described in International Patent Publications WO 95/18863 and WO 96/17823, and in U.S. Pat. No. 5,459,127. The use of lipofection to introduce exogenous genes into the specific organs in vivo has certain practical advantages and directing transfection to particular cell types would be particularly advantageous in a tissue with cellular heterogeneity, for example, pancreas, liver, kidney, and the brain. Lipids may be chemically coupled to other molecules for the purpose of targeting. Targeted peptides, e.g., hormones or neurotransmitters, and proteins for example, antibodies, or non-peptide molecules could be coupled to liposomes chemically. Other molecules are also useful for facilitating transfection of a nucleic acid in vivo, for example, a cationic oligopeptide (e.g., International Patent Publication WO 95/21931), peptides derived from DNA binding proteins (e.g., International Patent Publication WO 96/25508), or a cationic polymer (e.g., International Patent Publication WO 95/21931).

It is also possible to introduce a DNA vector in vivo as a naked DNA plasmid (see U.S. Pat. Nos. 5,693,622, 5,589,466 and 5,580,859). Naked DNA vectors for therapeutic purposes can be introduced into the desired host cells by methods known in the art, e.g., transfection, electroporation, microinjection, transduction, cell fusion, DEAE dextran, calcium phosphate precipitation, use of a gene gun, or use of a DNA vector transporter (see, e.g., Wilson, et al. (1992) J. Biol. Chem. 267:963-7; Wu and Wu, (1988) J. Biol. Chem. 263: 14621-4; Hartmut, et al. Canadian Patent Application No. 2,012,311, filed Mar. 15, 1990; Williams, et al (1991). Proc. Natl. Acad. Sci. USA 88:2726-30). Receptor-mediated DNA delivery approaches can also be used (Curiel, et al. (1992) Hum. Gene Ther. 3:147-54; Wu and Wu, (1987) J. Biol. Chem. 262:4429-32).

The invention further provides is a bone formation enhancing pharmaceutical composition comprising a therapeutically effective amount of an agent as described hereinabove, in admixture with a pharmaceutically acceptable carrier. Another preferred embodiment is pharmaceutical composition for the treatment or prevention of a condition involving a systemic or local decrease in mean bone density, or a susceptibility to the condition, comprising an effective bone formation enhancing amount of antagonists or inverse agonists of the polypeptides of the invention and/or pharmaceutically acceptable salts, hydrates, solvates, or prodrugs thereof in admixture with a pharmaceutically acceptable carrier.

The pharmaceutical composition may be composition, that may be solid, liquid, gel, or other form, in which the compound, polynucleotide, vector, and antibody of the invention is maintained in an active form, e.g., in a form able to effect a biological activity. For example, a compound of the invention would have inverse agonist or antagonist activity on the polypeptide; a nucleic acid would be able to replicate, translate a message, or hybridize to a complementary mRNA of the polypeptide; a vector would be able to transfect a target cell and expression the antisense, antibody, ribozyme or siRNA as described hereinabove; an antibody would bind a polypeptide domain.

Such compositions can be formulated for administration by topical, oral, parenteral, intranasal, subcutaneous, and intraocular, routes. Parenteral administration is meant to include intravenous injection, intramuscular injection, intraarterial injection or infusion techniques. The composition may be administered parenterally in dosage unit formulations containing standard, well-known non-toxic physiologically acceptable carriers, adjuvants and vehicles as desired.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the patient. Pharmaceutical compositions for oral use can be prepared by combining active compounds with solid excipient, optionally grinding a resulting mixture, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, or sodium carboxymethyl-cellulose; gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate. Dragee cores may be used in conjunction with suitable coatings, such as concentrated sugar solutions, which may also contain gum arabic, talc, polyvinyl-pyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations that can be used orally include push-fit capsules made of gelatin, as well as soft, sealed capsules made of gelatin and a coating, such as glycerol or sorbitol. Push-fit capsules can contain active ingredients mixed with filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquid polyethylene glycol with or without stabilizers.

Preferred sterile injectable preparations can be a solution or suspension in a non-toxic parenterally acceptable solvent or diluent. Examples of pharmaceutically acceptable carriers are saline, buffered saline, isotonic saline (e.g. monosodium or disodium phosphate, sodium, potassium; calcium or magnesium chloride, or mixtures of such salts), Ringer's solution, dextrose, water, sterile water, glycerol, ethanol, and combinations thereof 1,3-butanediol and sterile fixed oils are conveniently employed as solvents or suspending media. Any bland fixed oil can be employed including synthetic mono- or di-glycerides. Fatty acids such as oleic acid also find use in the preparation of injectables.

The composition medium can also be a hydrogel, which is prepared from any biocompatible or non-cytotoxic homo- or hetero-polymer, such as a hydrophilic polyacrylic acid polymer that can act as a drug absorbing sponge. Certain of them, such as, in particular, those obtained from ethylene and/or propylene oxide are commercially available. A hydrogel can be deposited directly onto the surface of the tissue to be treated, for example during surgical intervention.

Embodiments of pharmaceutical compositions of the present invention comprise a replication defective recombinant viral vector encoding the polynucleotide inhibitory agent of the present invention and a transfection enhancer, such as poloxamer. An example of a poloxamer is Poloxamer 407, which is commercially available (BASF, Parsippany, N.J.) and is a non-toxic, biocompatible polyol. A poloxamer impregnated with recombinant viruses may be deposited directly on the surface of the tissue to be treated, for example during a surgical intervention. Poloxamer possesses essentially the same advantages as hydrogel while having a lower viscosity.

The active expression-inhibiting agents may also be entrapped in microcapsules prepared, for example, by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (1980) 16th edition, Osol, A. Ed.

Sustained-release preparations may be prepared. Suitable examples of sustained-release preparations include semi-permeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and gamma-ethyl-L-glutamate, non-degradable ethylene-vinyl acetate, degradable lactic acid-glycolic acid copolymers such as the LUPRON DEPOT™. (injectable microspheres composed of lactic acid-glycolic acid copolymer and leuprolide acetate), and poly-D-(–)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

As defined above, therapeutically effective dose means that amount of protein, polynucleotide, peptide, or its antibodies, agonists or antagonists, which ameliorate the symptoms or condition. Therapeutic efficacy and toxicity of such compounds can be determined by standard pharmaceutical procedures in cell cultures or experimental animals, e.g., ED50 (the dose therapeutically effective in 50% of the population) and LD50 (the dose lethal to 50% of the population). The dose ratio of toxic to therapeutic effects is the therapeutic index, and it can be expressed as the ratio, LD50/ED50. Pharmaceutical compositions that exhibit large therapeutic indices are preferred. The data obtained from cell culture assays and animal studies is used in formulating a range of dosage for human use. The dosage of such compounds lies preferably within a range of circulating concentrations that include the ED50 with little or no toxicity. The dosage varies within this range depending upon the dosage form employed, sensitivity of the patient, and the route of administration.

For any compound, the therapeutically effective dose can be estimated initially either in cell culture assays or in animal models, usually mice, rabbits, dogs, or pigs. The animal model is also used to achieve a desirable concentration range and route of administration. Such information can then be used to determine useful doses and routes for administration in humans. The exact dosage is chosen by the individual physician in view of the patient to be treated. Dosage and administration are adjusted to provide sufficient levels of the active moiety or to maintain the desired effect. Additional factors which may be taken into account include the severity of the disease state, age, weight and gender of the patient; diet, desired duration of treatment, method of administration, time and frequency of administration, drug combination(s), reaction sensitivities, and tolerance/response to therapy. Long acting pharmaceutical compositions might be administered every 3 to 4 days, every week, or once every two weeks depending on half-life and clearance rate of the particular formulation.

The pharmaceutical compositions according to this invention may be administered to a subject by a variety of methods.

They may be added directly to target tissues, complexed with cationic lipids, packaged within liposomes, or delivered to target cells by other methods known in the art. Localized administration to the desired tissues may be done by catheter, infusion pump or stent. The DNA, DNA/vehicle complexes, or the recombinant virus particles are locally administered to the site of treatment. Alternative routes of delivery include, but are not limited to, intravenous injection, intramuscular injection, subcutaneous injection, aerosol inhalation, oral (tablet or pill form), topical, systemic, ocular, intraperitoneal and/or intrathecal delivery. Examples of ribozyme delivery and administration are provided in Sullivan et al. WO 94/02595.

Antibodies according to the invention may be delivered as a bolus only, infused over time or both administered as a bolus and infused over time. Those skilled in the art may employ different formulations for polynucleotides than for proteins. Similarly, delivery of polynucleotides or polypeptides will be specific to particular cells, conditions, locations, etc.

As discussed hereinabove, recombinant viruses may be used to introduce DNA encoding polynucleotide agents useful in the present invention. Recombinant viruses according to the invention are generally formulated and administered in the form of doses of between about $10^4$ and about $10^{14}$ pfu. In the case of AAVs and adenoviruses, doses of from about $10^6$ to about $10^{11}$ pfu are preferably used. The term pfu ("plaque-forming unit") corresponds to the infective power of a suspension of virions and is determined by infecting an appropriate cell culture and measuring the number of plaques formed. The techniques for determining the pfu titre of a viral solution are well documented in the prior art.

A further aspect of the invention relates to a method of treating or preventing a disease involving a systemic or local descrease in mean bone density, comprising administering to said subject a bone formation enhancing pharmaceutical composition as described herein.

The invention also relates to the use of an agent as described above for the preparation of a medicament for treating or preventing a disease involving a systemic or local descrease in mean bone density.

In a preferred embodiment of the present invention the disease is selected from the group consisting of osteoporosis, hypercalcemia of malignancy, multiple myelomatosis, hyperparathyroidism, and hyperthyroidism. A special embodiment of this invention is a method wherein the disease is osteoporosis.

Still another aspect or the invention relates to a method for diagnosing a pathological condition involving a systemic or local decrease in mean bone density or a susceptibility to the condition in a subject, comprising determining the amount of polypeptide comprising an amino acid sequence selected from the group consisting of SEQ ID NO: 194-309 in a biological sample, and comparing the amount with the amount of the polypeptide in a healthy subject, wherein an increase of the amount of polypeptide compared to the healthy subject is indicative of the presence of the pathological condition.

Preferably the pathological condition is selected from the group consisting of osteoporosis, hypercalcemia of malignancy, multiple myelomatosis, hyperparathyroidism, and hyperthyroidism. More preferably, the pathological condition is osteoporosis.

The polypeptides or the polynucleotides of the present invention employed in the methods described herein may be free in solution, affixed to a solid support, borne on a cell surface, or located intracellularly. To perform the methods it is feasible to immobilize either the polypeptide of the present invention or the compound to facilitate separation of complexes from uncomplexed forms of the polypeptide, as well as to accommodate automation of the assay. Interaction (e.g., binding of) of the polypeptide of the present invention with a compound can be accomplished in any vessel suitable for containing the reactants. Examples of such vessels include microtitre plates, test tubes, and microcentrifuge tubes. In one embodiment, a fusion protein can be provided which adds a domain that allows the polypeptide to be bound to a matrix. For example, the polypeptide of the present invention can be "His" tagged, and subsequently adsorbed onto Ni-NTA microtitre plates, or ProtA fusions with the polypeptides of the present invention can be adsorbed to IgG, which are then combined with the cell lysates (e.g., $(35)^S$-labelled) and the candidate compound, and the mixture incubated under conditions favorable for complex formation (e.g., at physiological conditions for salt and pH). Following incubation, the plates are washed to remove any unbound label, and the matrix is immobilized. The amount of radioactivity can be determined directly, or in the supernatant after dissociation of the complexes. Alternatively, the complexes can be dissociated from the matrix, separated by SDS-PAGE, and the level of the protein binding to the protein of the present invention quantitated from the gel using standard electrophoretic techniques.

Other techniques for immobilizing protein on matrices can also be used in the method of identifying compounds. For example, either the polypeptide of the present invention or the compound can be immobilized utilizing conjugation of biotin and streptavidin. Biotinylated protein molecules of the present invention can be prepared from biotin-NHS (N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with the polypeptides of the present invention but which do not interfere with binding of the polypeptide to the compound can be derivatized to the wells of the plate, and the polypeptide of the present invention can be trapped in the wells by antibody conjugation. As described above, preparations of a labeled candidate compound are incubated in the wells of the plate presenting the polypeptide of the present invention, and the amount of complex trapped in the well can be quantitated.

The polynucleotides of the invention of SEQ ID NO: 1-77 have been shown to increase osteoblast differentiation.

Accordingly, another embodiment of the present invention relates to a method for in vitro production of bone tissue, comprising the steps of contacting undifferentiated mammalian cells with a polynucleotide sequence comprising a sequence selected from the group consisting of SEQ ID No: 1-77, preferably selected from the group consisting of SEQ ID No: 69-77 for a time sufficient to differentiate the undifferentiated cells into osteoblasts, thereby producing a continuous bone matrix.

In a preferred embodiment, the method comprises the steps of:

(a) applying undifferentiated mammalian cells on a substrate to form a cellular substrate, (b) introducing a polynucleotide sequence or a vector comprising a nucleotide sequence selected from the group consisting of SEQ ID NO: 1-77, preferably selected from the group consisting of 69-77, for a time sufficient to differentiate the undifferentiated cells into osteoblasts, thereby producing a continuous bone matrix.

The invention thus provides a method for producing a substrate with a matrix grown thereon, which can be used for the provision of load-bearing implants, including joint prostheses, such as artificial hip joints, knee joints and finger joints, and maxillofacial implants, such as dental implants. It can also be used for special surgery devices, such as spacers, or bone fillers, and for use in augmentation, obliteration or reconstitution of bone defects and damaged or lost bone. Bone formation can be optimized by variation in mineralization, both by inductive and by conductive processes.

A combination of the provision of a load-bearing implant (preferably coated with a matrix as described above) with a bone filler comprising a matrix as described, constitutes an advantageous method according to the present invention.

The method of the invention is also very suitable in relation to revision surgery, i.e., when previous surgical devices have to be replaced.

Suitable undifferentiated cells are bone marrow cells, including haematopoietic cells and in particular stromal cells. The marrow cells, and especially the stromal cells are found to be very effective in the bone producing process when taken from their original environment.

The undifferentiated cells can be directly applied on the substrate or they can advantageously be multiplied in the absence of the substrate before being applied on the substrate. In the latter mode, the cells are still largely undifferentiated after multiplication and, for the purpose of the invention, they are still referred to as undifferentiated. Subsequently, the cells are allowed to differentiate. Differentiation can be induced or enhanced by the presence of suitable inductors, such as glucocorticoids, and dexamethasone. Especially suitable inductors of differentiation are the expression inhibitory agents of the present invention.

The use of undifferentiated cells provides several advantages. Firstly, their lower differentiation implies a higher proliferation rate and allows the eventual functionality to be better directed and controlled. Moreover, culturing these cells not only produces the required bone matrix containing organic and inorganic components, but also results in the presence, in the culture medium and in the matrix, of several factors which are essential for growth of the tissue and for adaptation to existing living tissue. Also, the culture medium can be a source of active factors such as growth factors, to be used in connection with the implanting process. Furthermore, such undifferentiated cells are often available in large quantities and more conveniently than e.g., mature bone cells, and exhibit a lower morbidity during recovery. Moreover, the undifferentiated cells can be obtained from the patient for whom the implant is intended. The bone resulting from these cells is autologous to the patient and thus no immune response will be induced. Matrices as thick as 100 µm can be produced as a result of the use of undifferentiated cells.

The substrate on which the undifferentiated cells can be applied and cultured can be a metal, such as titanium, cobalt/chromium alloy or stainless steel, a bioactive surface such as a calcium phosphate, polymer surfaces such as polyethylene, and the like. Although less preferred, siliceous material such as glass ceramics, can also be used as a substrate. Most preferred are metals, such as titanium, and calcium phosphates, even though calcium phosphate is not an indispensable component of the substrate. The substrate may be porous or non-porous. The cells can be applied at a rate of e.g., $10^3$-$10^6$ per $cm^2$, in particular $10^4$-$2 \times 10^5$ cells per $cm^2$.

The culture medium to be used in the method according to the invention can be a commonly known culture medium such as MEM (minimum essential medium). Advantageously, the medium can be a conditioned medium. In this context, a conditioned medium is understood to be a medium wherein similar cells have previously been incubated, causing the medium to contain factors such as polypeptides, secreted by the cells which are important for cell growth and cell differentiation.

The cells are cultured for a time sufficient to produce a matrix layer, e.g., a matrix layer having a thickness of at least 0.5 µm, in particular from 1 up to 100 µm, more in particular of 10-50 µm. The cells may be contacted with the culture medium for e.g. 2-15 weeks, in particular 4-10 weeks.

The production of the matrix, when applied on a substrate, results in a continuous or quasi-continuous coating covering the substrate for at least 50%, in particular at least 80% of its surface area.

The present invention further relates to the osteoblast cells obtainable by the above method.

The invention is further illustrated in the following figures and examples.

Figure 2:
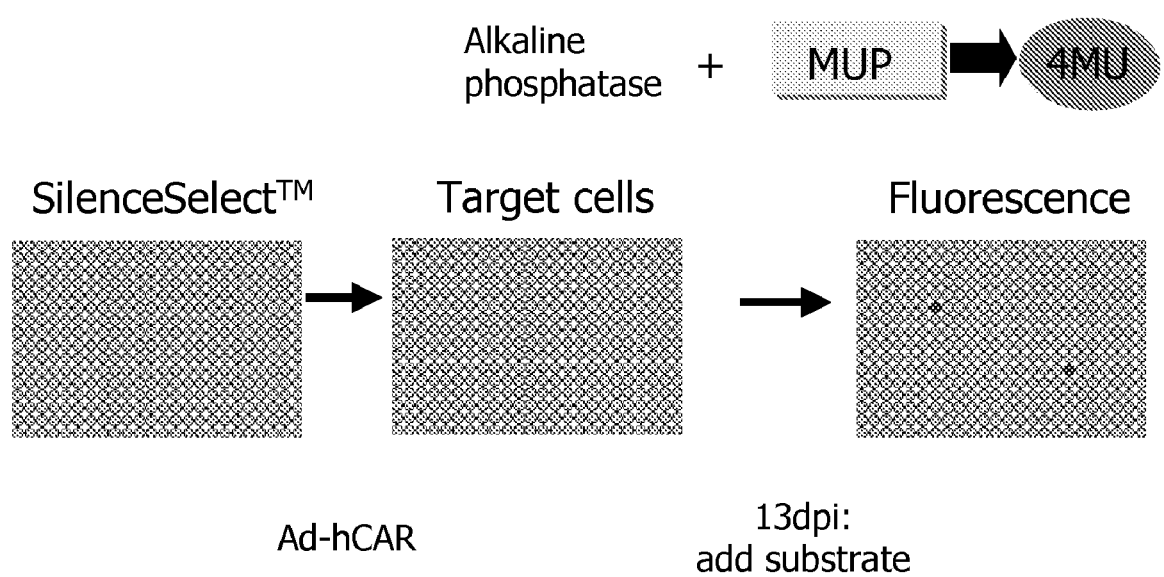
Figure 3:
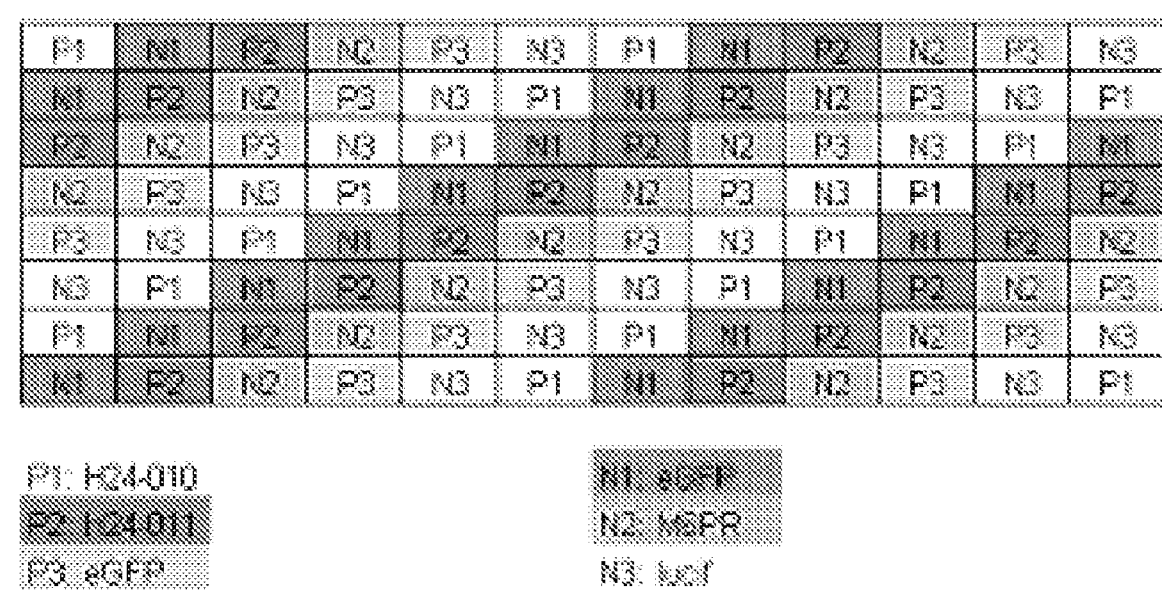
Figure 5:

FIG. 1. Intramembranous and endochondral ossification.
FIG. 2. Principle of the osteoblast differentiation assay.
FIG. 3. Lay-out of the 96 well knock-down control plate.
FIG. 4. Lay-out of the 384 well control plate.
FIG. 5. Performance of the knock-down control plate in the AP assay
FIG. 6. Dot plot representation of raw data for one SilenceSelect screening plate
FIG. 7. Analyzing the upregulation of BAP-mRNA versus PLAP- or IAP-mRNA
FIG. 8. Results mineralization assay
FIG. 9. Pipetting scheme used for screening the Ad-shRNAs at 3 MOIs.

EXAMPLES

Example 1

Development of a High-throughput Screening Method for the Detection of Endogenous Alkaline Phosphatase Principle of the Assay Mesenchymal progenitor cells (MPCs) are determined to differentiate into osteoblasts in the presence of appropriate factors (e.g. BMP2). An assay to screen for such factors was developed by monitoring the activity of alkaline phosphatase (AP) enzyme, an early marker in the osteoblast differentiation program. MPCs were seeded in 384 well plates and simultaneously co-infected one day later with adenoviruses encoding the human coxsackie and adenovirus receptor (hCAR; Ad-hCAR) and individual siRNA adenoviruses (Ad-siRNA) from the SilenceSelect™ collection. AdC15-hCAR/AdC20-hCAR co-infection increases the AdC01-siRNA infection efficiency. Cellular AP activity was determined 13 days after the start of the infection (13 dpi). FIG. 2 illustrates the principle of the assay.

Development of the Assay

MPCs were isolated from bone marrow of healthy volunteers, obtained after informed consent (Cambrex/Biowhittaker, Verviers, Belgium).

In a series of experiments, carried out in 384 well plates, several parameters were optimized: cell seeding density, multiplicities of infection (MOI) of control viruses (Ad-BMP2 or Ad-eGFP), MOI of Ad-hCAR, duration of infection, toxicity, infection efficiency (using Ad-eGFP) and the day of readout.

Using Ad-BMP2 (BMP2 overexpression) as a positive control for assay development, the following protocol resulted in the highest dynamic range for the assay with the lowest standard deviation on the background signal: MPCs were seeded on day0 at 500 cells per well of a 384 well plate and co-infected the next day using a mix of Ad-hCAR (5 µl of an Ad-hCAR solution: mix total MOI=155.7) and 1 µl of Ad-control-virus (Ad-BMP2 or Ad-eGFP; corresponds to a theoretical MOI of 5000). On day5, the medium containing virus was removed and replaced by fresh medium containing no virus. Upregulation of alkaline phosphatase was read at 13 dpi: 15 µl 4-Methylumbelliferylphosphate (MUP, Sigma) was added to each well, the plates were incubated for 15 min at 37° C. and monitored for AP activity using a fluorescence plate reader (Fluostar, BMG).

After optimisation of the assay, a small pilot screen was run (103 different Ad-siRNA viruses) with the use of robotics (96/384 channel dispenser Tecan Freedom 200 equipped with TeMO96, TeMO384 and RoMa, Tecan AG, Switzerland). The hits from this screen were collected and retested in the same assay. The two Ad-siRNAs that scored strongest (H9=H24-010; H10=H24-011) were used to generate a control plate (knock-down (KD) control plate) containing Ad-siRNAs. The control plate, a 96 well plate containing 3 negative (N1, N2, N3) and 3 positive (P1, P2, P3) control viruses is depicted in FIG. 3. This "knock-down" control plate contains Ad-H9 (H24-010) and Ad-H10 (H24-011) as positive controls; Ad-eGFP (knock-in virus) as infection control; and Ad-eGFP-siRNA, Ad-M6PR-siRNA and Ad-Luc-siRNA (all 3 are knock-down viruses) as negative controls.

The control viruses were pipetted from 96 well KD control plates into 384 well plates using robotics. The final lay-out of the 384 well plate is depicted in FIG. 4.

FIG. 5 shows results from the automated screening procedure using the KD control plate. The mean and standard deviations of the KD negative controls (N1-N3) were used to calculate a cut-off for hit analysis, which was set at the mean for N1, N2, N3 ('All negatives') plus 3 times the standard deviation for 'All negatives'. The positive controls (P1 and P2), scored in more than 95% of the infected wells. The negative control viruses scored in less than 5% of the wells.

Example 2

Screening of 2760 Ad-siRNA Adenoviruses in the Osteogenesis Assay

Figure 6:
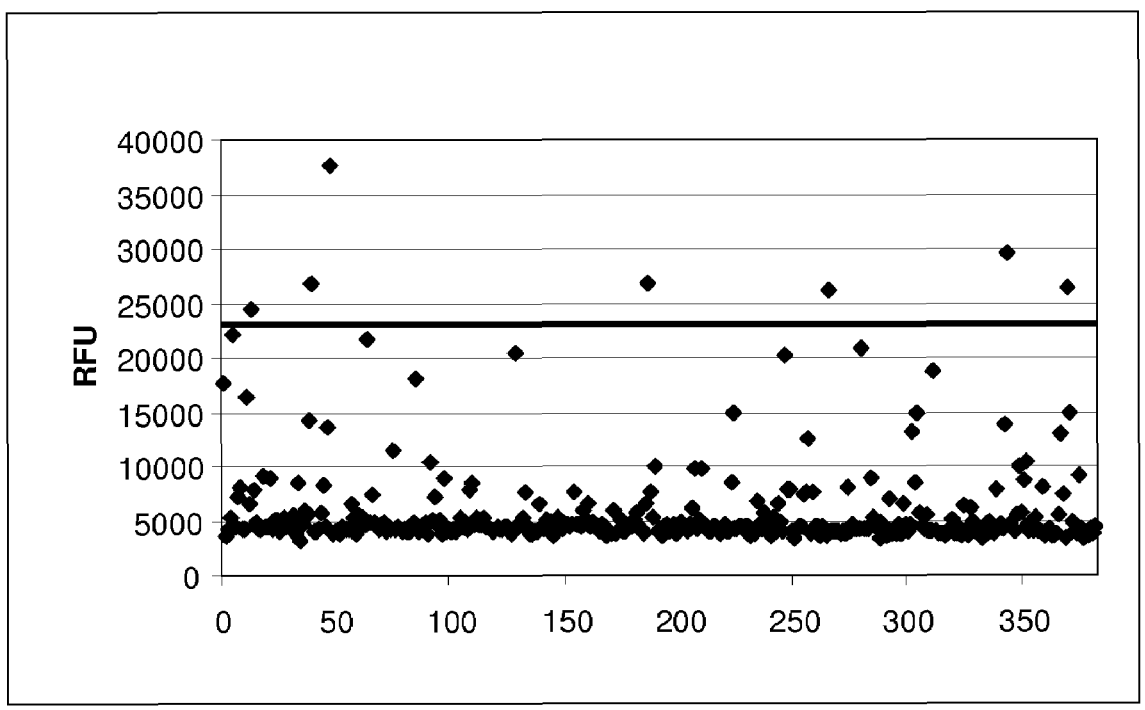

The optimized protocol for screening the SilenceSelect library is the following: on day 0, MPC cells are seeded in black 384 well plates with clear bottom (Costar or Nunc) in 60 µl medium at a density of 500 cells per well. One day later, 1 µl Ad-siRNA virus from the SilenceSelect™ collection, stored in 384 well plates (estimated titer of $2.5 \times 10^9$ viral particals per ml) and 5 µl of Ad-hCAR solution (total MOI=155), dispensed in 96 well V-bottom plates, is transferred with the aid of a 96/384 channel dispenser (Tecan Freedom 200 equipped with TeMO96, TeMO384 and RoMa, Tecan AG, Switzerland) from the wells of a 96 well plate containing the Ad-hCAR solution to each of the wells of the 384 well plates containing MPCs. The KD control plate was run under the same conditions as the aliquot plates from the SilenceSelect collection. All Ad-siRNA viruses were screened in duplicate, with each singular on a different MPC plate. Plates were then incubated at 37° C. Four days post infection the medium containing the adenoviruses was replaced by fresh medium free of virus. Thirteen days post infection, the AP activity readout was performed. A typical result of a 384 well screening plate is depicted in FIG. 6, in which the relative fluorescence units (RFU) are plotted for each of the data points of the 384 well plate on the Y-axis; while the numbers on the X-axis correspond to positions in the 384 well plate.

This duplicate screen was done twice, and all four data points were used for hit calling (see Example 3).

Example 3

Target Identification Using the AP Assay

After performing these 2 screens, the data obtained from measuring the AP activity were analyzed as follows: the background was calculated by taking the mean of the data points from all the plates except the control plate. A cut-off value for hit calling was calculated by adding 3 times the standard deviation of all data points, excluding the control plate. Each data point was analyzed for scoring above or under the cut-off. Only Ad-siRNAs inducing endogenous AP activity levels above the cut-off were of further interest. Hits were prioritized according to their scoring in single or duplo, in one or both of the screens. Data were collected for 2688 Ad-siRNA virus constructs representing 2657 independent KD constructs and are listed in table 2. One of the identified hits has been shown to be a bone anabolic factor before and therefore validates the assay:

H24-241: BMP3

BMP3 is a member of the bone morphogenetic protein family of secreted proteins. BMP3 functions as an antagonist for the osteogenic BMP2. BMP3-null mice have twice as much trabecular bone as wild-type animals indicating that BMP3 is a negative regulator of bone homeostasis in vivo (Daluiski et al., *Nature Genetics* (2001) 27:84-88).

Example 4

Quality Control of the Target Ad-siRNAs

The Ad-siRNA hits were subjected to a quality control on the siRNA insert.

Target Ad-siRNAs were propagated using PerC6 cells (Crucell, Leiden, The Netherlands) at a 96 well plate level, followed by rescreening these viruses at several MOIs in the primary assay (see Example 1) and by sequencing the siRNAs encoded by the target Ad-siRNA viruses.

PerC6/E2A cells were seeded in 96 well plates at a density of 40 000 cells per well in 180 µl PerC6/E2A medium. Cells were then incubated overnight at 39° C. in a 10% $CO_2$ humidified incubator. One day later, cells were infected with 1 µl of crude cell lysate from SilenceSelect stocks containing target Ad-siRNAs. Cells were incubated further at 34° C., 10% $CO_2$ until appearance of cytopathic effect (as revealed by the swelling and rounding up of the cells, typically 7 days post infection). The supernatant was collected and the virus crude lysate was treated with proteinase K: 12 µl crude lysate was added to 4 µl Lysis buffer (1× Expand High Fidelity buffer with $MgCl_2$ (Roche Molecular Biochemicals, Cat. No 1332465) supplemented with 1 mg/ml proteinase K (Roche Molecular Biochemicals, Cat No 745 723) and 0.45% Tween-20 (Roche Molecular Biochemicals, Cat No 1335465) in sterile PCR tubes. These were incubated at 55° C. for 2 h followed by a 15 min inactivation step at 95° C. For the PCR reaction, 1 µl lysate was added to a PCR master mix composed of 5 µl 10× Expand High Fidelity buffer with $MgCl_2$, 0.5 µl of dNTP mix (10 mM for each dNTP), 1 µl of 'Forward primer' (10 mM stock, sequence: 5'CCG TTT ACG TGG AGA CTC GCC, SEQ ID NO: 311), 1 µl of 'Reverse Primer' (10 mM stock, sequence: 5' CCC CCA CCT TAT ATA TAT TCT TTC C, SEQ ID NO: 312), 0.2 µl of Expand High Fidelity DNA polymerase (3.5 U/µl, Roche Molecular Biochemicals) and 41.3 µl of $H_2O$. PCR was performed in a PE Biosystems GeneAmp PCR system 9700 as follows: the PCR mixture (50 μl in total) was incubated at 95° C. for 5 min; each of 35 subsequent cycles ran at 95° C. for 15 sec, 55° C. for 30 sec, 68° C. for 4 min. A final incubation at 68° C. was performed for 7 min. 5 μl of the PCR mixture was mixed with 2 μl of 6×gel loading buffer, loaded on a 0.8% agarose gel containing 0.5 μg/μl ethidium bromide to resolve the amplification products. The size of the amplified fragments was estimated from a standard DNA ladder loaded on the same gel. The expected size was ~500 bp.

For sequencing analysis, the siRNA constructs expressed by the target adenoviruses were amplified by PCR using primers complementary to vector sequences flanking the SapI site of the pIPspAdapt6-U6 plasmid. The sequence of the PCR fragments was determined and compared with the expected sequence.

Example 5

Analysis of the Upregulation of Endogenous Bone AP mRNA Versus that of Placental or Intestinal AP mRNA BAP is the physiologically relevant AP involved in bone formation. In order to determine whether the measured AP activities were due to upregulation of BAP expression or of another AP gene product, mRNA levels for all AP genes were analysed for infected MPCs.

mRNA levels were determined as described in the previous sections. The difference is in the primer set used (see Table 1): one set detects BAP ALPL (human alkaline phosphatase liver/bone/kidney) mRNA expression. Another set detects the expression of the 3 other AP genes (ALPI (human alkaline phosphatase intestinal), ALPP (human alkaline phosphatase placental (PLAP)), and ALPPL2 (human alkaline phosphatase placental-like)). ALPI, ALPP and ALPPL2 are highly similar at the nucleotide level and can therefore be amplified using one primer pair.

Figure 7:
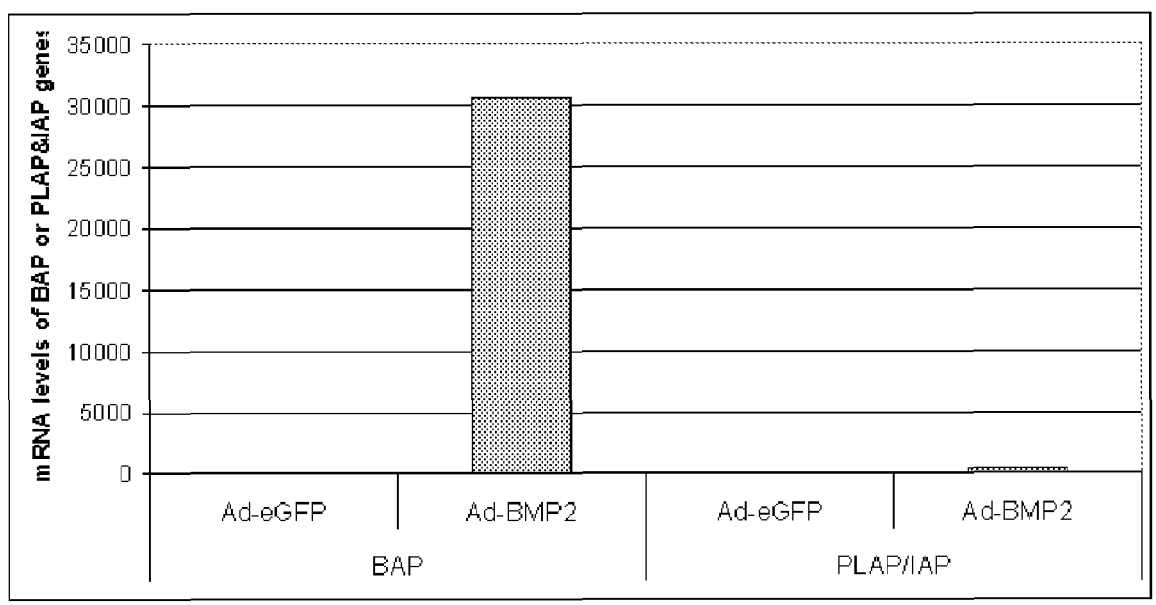
Figure 8:
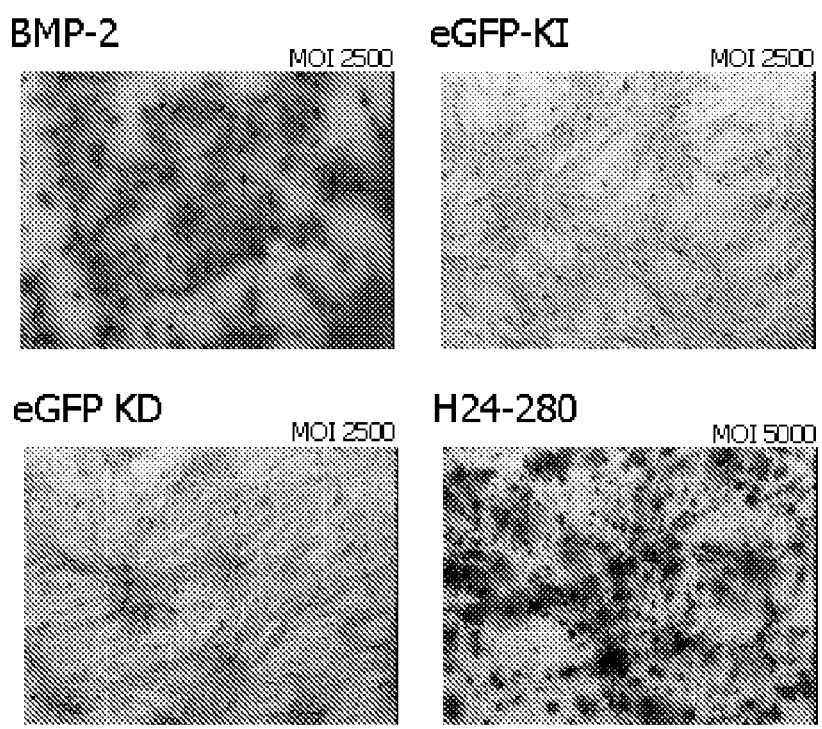

The primer pairs were first validated on RNA isolated from MPCs infected with Ad-eGFP and Ad-BMP2. FIG. 7 illustrates the strong upregulation of BAP mRNA by Ad-BMP2 and the absence of upregulation of expression of any of the other AP genes. MPCs were infected in 24 well plate format using Ad-eGFP (negative control) or the osteogenic Ad-BMP2. Cells were harvested and RNA was prepared and subjected to rtRT-PCR using primer sets amplifying BAP mRNA or mRNA from the other 3 AP genes (PLAP/IAP). Ad-BMP2 strongly upregulates BAP mRNA levels but not the mRNA levels of the other 3 AP genes.

Both primer sets were then used to measure mRNA levels for all AP genes in RNA isolated from Ad-siRNA infected MPCs.

TABLE 1

AP primer sets

| Name | Sequence | SEQ ID NO: |
|---|---|---|
| JDO-05F (PLAP) | TTCCAGACCATTGGCTTGAGT | 313 |
| JDO-05bis R (PLAP/ALPI/ALPPL2) | ACTCCCACTGACTTTCCTGCT | 314 |
| JDO-21F (BAP) | CATGCTGAGTGACACAGACAAGAAG | 315 |
| JDO-21R (BAP) | TGGTAGTTGTTGTGAGCATAGTCCA | 316 |

Example 6

Mineralization

The process of osteogenesis consists of several successive events. During the initial phases of osteogenesis, bone alkaline phosphatase (BAP) becomes upregulated. It is however equally important to look at specific events occurring in later stages of osteogenesis such as mineralization.

Assay Setup

The process of osteogenesis consists of several successive events. During the initial phases of osteogenesis, bone alkaline phosphatase (BAP) becomes upregulated. Later, during differentiation, cells deposit (hydroxy)apatite ($Ca^{2+}$-phosphate precipitate) on an extracellular matrix consisting mostly of collagen type I to form mineralized bone.

In the bone cell mineralizing assay (BM assay), primary human MSCs are differentiated in vitro into mineralizing osteoblasts using BMP2 (recombinant or delivered by adenoviral transduction) as an osteogenic agent. Mineralization is then visualized by staining the MSCs with Alizarin Red, a dye with a high affinity for calcium (see FIG. 8).

Screening and Hit Calling

The following optimized protocol was used for screening Ad-siRNA and Ad-cDNA targets identified in the primary assay:

100,000 MPCs were seeded in each well of a 6 well plate in 2 ml MSC medium, containing 10% FCS. The next day, after incubation at 37° C., 10% $CO_2$ in a humidified incubator, cells were co-infected with AdC15-hCAR (final MOI of 750) and Ad-siRNA, Ad-cDNA or control viruses at a final MOI of 1250, 2500 and 5000. Cells were incubated at 37° C., 10% $CO_2$ in a humidified incubator for a further six days. Virus was removed and replaced by 2 ml fresh MSC medium, 10% FCS. Over the next 22 days, medium was refreshed 3 times in 2 weeks. Every other time, medium was refreshed half or completely. At 28 days after the start of the experiment, the conditioned medium was removed, cells were fixed using 10% paraformaldehyde and the monolayers stained with 1 mL of ~1% Alizarin Red (Sigma, # A5533) in MilliQ water (pH adjusted to 4.2). Ad-eGFP, to assess infection efficiency, Ad-BMP2 as strong osteogenic inducer and Ad-H4-2 as a weak osteogenic factor were included in each experiment as negative and positive controls, respectively. Every experiment where Ad-H4-2 did not induce mineralization was entirely repeated.

The Ad-shRNAs that induced mineralization are presented in Table 2.

Example 7

Drug Discovery against the Identified Targets

Compounds are screened for binding to the polypeptides of the present invention. The affinity of the compounds to the polypeptides is determined in a displacement experiment. Such displacement experiments are well known in the art, and can be considered as a common technique among others to identify compounds that bind to polypeptides.

In brief, the polypeptides of the present invention are incubated with a labeled (radio-labeled, fluorescent- or antibody-labeled, or any other detectable label) ligand that is known to bind to the polypeptide and is further incubated with an unlabeled compound.

The displacement of the labeled ligand from the polypeptide is determined by measuring the amount of labeled ligand that is still associated with the polypeptide. The amount of the labeled ligand associated with the peptide is an indication of the affinity for the unlabeled compound.

The amount of labeled ligand associated with the polypeptide is plotted against the concentration of the unlabeled compound to calculate IC50 values. This value reflects the binding affinity of the unlabeled compound to its target, i.e. the polypeptides of the present invention.

Compounds are considered strong binders, when having an IC50 in the nanomolar and even picomolar range. Compounds that have an IC50 of at least 10 micromol or even better in the nmol to pmol range are applied in either the bone alkaline phosphatase assay (BAP) and/or in assays to determine their effect on the induction of osteoblast markers and osteoblast function. Compounds with a lower IC50 are generally considered as of less interest. The polypeptides of the present invention can be prepared in a number of ways depending on whether the assay will be run on cells, cell fractions or biochemically, on purified proteins. Such preparations are well known in the art, as are the different assays.

Example 8

Osteoclast Assays: Validate Anti-resorptive Activity of Identified Targets

Throughout life, the skeleton is in a constant state of remodeling. Focal areas of bone are resorbed by osteoclasts and then replaced by bone matrix newly formed by osteoblasts. The development of osteoporosis is characterized by severe bone loss due to the deregulation of the balance between osteoclast and osteoblast activity, leading to an increased osteoclast-mediated bone resorption.

Osteoclasts emanate from cells of the monocyte/macrophage lineage. In vivo, the differentiation of osteoclast precursor cells towards osteoclasts is controlled by two central factors expressed by stromal cells (MPCs): receptor activator of NFκB ligand (RANKL) and osteoprotegerin (OPG). RANKL is a membrane bound ligand expressed on the surface of MPCs which drives osteoclast differentiation. OPG is a soluble decoy receptor for RANKL which inhibits osteoclast differentiation by scavenging active RANKL. The balance between RANKL and OPG expression by MPCs determines the level of osteoclast differentiation.

As MPCs control the differentiation of osteoclasts, it is important to know the effect of the identified target Ad-siRNAs on osteoclast differentiation or activity. Target Ad-siRNAs that decrease osteoclast differentiation/activity, are very valuable, as these are expected to increase bone apposition by two mechanisms: increase of differentiation/activity of osteoblasts and decrease in osteoclast activity. As illustrated by various precedents (Thirunavukkarasu et al., (2000) *J Biol Chem* 275: 25163-72; Yamada et al., (2003) *Blood* 101: 2227-34) such a pleiotropic effect of osteogenic factors can be expected.

Osteoclast Differentiation Assay

The effect of osteogenic factors on osteoclastogenesis is evaluated through two types of assays.

In a first assay setup, a coculture of MPCs with primary human mononuclear cells is performed. The effect of the infection of the MPC monolayer with a knock-down virus on its capacity to support osteoclastogenesis is evaluated. The desired effect is the following: knock-down of the Ad-siRNA target gene expression in the MPCs should inhibit osteoclast differentiation driven by a physiological trigger as e.g. a mixture of 10 nM $1,25(OH)_2vitD_3$ and 50 nM M-CSF. The monocytes used can be derived from bone marrow or peripheral blood. In the present example, a differentiation experiment based on peripheral blood derived mononuclear cells (PBMCs) is described. MPCs (obtained from Cambrex/Biowhittaker, Verviers, Belgium) are seeded in 96 well plates (1000 cells per well) in α-MEM medium (GIBCO-Life Technologies) supplemented with 10% FBS and a day later, these are infected with a target Ad-siRNA. At least three days later, 100 000 PBMCs per well are added as well as M-CSF (R&D systems, 50 ng/ml final concentration). Half the volume of medium is refreshed twice a week by medium+50 ng/ml M-CSF and 10 nM $1,25(OH)_2vitD_3$. Readout is performed 14 days after addition of the PBMCs to the coculture. Spontaneous osteoclast differentiation driven by the physiologically relevant mixture of triggers can be assessed by multiple readouts. Microscopic assessment of the number of 'TRAP positive', multinucleated cells per well is a generally accepted measure for the level of osteoclast differentiation. 'TRAP positive' means that the cells possess a tartrate resistant acidic phosphatase (TRAP) activity. To assess this, the coculture is subjected to an in situ TRAP staining performed according to the Acid Phosphatase detection kit (SIGMA, 386-A). Positive cells aquire a purple color upon treatment. As an alternative readout, a marker specific for mature osteoclasts is measured e.g. TRACP5b (tartrate resistant acidic phosphatase type 5b), calcitonin receptor (CTR) or Cathepsin K (CTSK). Measurement of the amounts of osteoclast-derived tartrate resistant acidic phosphatase protein (TRACP5b) in the coculture supernatant is performed by a commercially available ELISA (BoneTRAP assay, Sba sciences, Turku, Finland). CTR or CTSK are detected by immunocytochemistry, upon application of following general protocol. Medium is removed and the coculture is fixed (4% paraformaldehyde, 0.1% TritonX-100, 4° C., 30 min), washed and blocking buffer (PBS+1% BSA+0.1% Tween20) is added for an incubation of at least 4 hrs. The blocking buffer is removed and the primary antibody directed against CathepsinK (e.g. Oncogene, IM55L) or Calcitonin receptor (e.g. Serotec, AHP635), dissolved at the desired concentration in a suited buffer (e.g. 0.05M Tris.HCl pH 7.4, 1% BSA), is added to the wells. Incubation is performed overnight, 4° C. The mixture is removed, the cells washed (PBS+0.1% Tween20) and the suited, HRP conjugated secondary antibody, diluted in the same buffer as the primary antibody, is added. After an incubation of at least 4 hrs, a washing step is performed (PBS+0.1% Tween20) and luminol (a substrate for HRP yielding a luminescent signal: BM Chemiluminescence ELISA Substrate [POD] (luminol), Roche Diagnostics, Cat No 1582950) is added. After 5 min incubation, readout is performed with a luminometer (Luminoskan Ascent, Labsystem). The 2 assays described (assessment of the amount of multinuclear cells and immunochemistry for the detection of osteoclast-specific markers) allow to assess the differentiation of the mononuclear cells towards osteoclasts, but do not yield information about the bone resorptive activity of the osteoclasts formed.

Activity of the osteoclasts is measured in the pit formation assay. For this purpose, the co-culture and infection of cells is performed as described for assays described above with the difference that a bone-like substrate is present at the bottom of the well in which the co-culture is performed. This bone-like substrate can be a dentin slice (e.g. Kamiya Biomedical Company, Seattle (Cat No KT018)) or equivalent (Calcium carbonate coating, OAAS™, Gentaur; Biocoat™ Osteologic™, BD Biosciences) that is commercially available. The co-culture is performed for at least 14 days on the bone like substrate. Cells are then removed by treatment with sodium hypochlorite and the area resorbed by the osteoclasts (the resorption pit) can be assessed microsopically. This can be facilitated by the treatment of the surface of the dentin slice with toluidine blue.

In a second assay setup, the effect of the infection of the osteoclast precursor cells (PBMCs or BMMCs) with a hit virus on its ability to differentiate towards an osteoclast is measured in a monoculture assay. For this purpose, the monocytes (PBMCs or BMMCs) are seeded in a 384 well plate in αMEM medium supplemented with 10% serum and 25 ng/ml recombinant M-CSF (R&D systems). One day after seeding, the cells are infected with target Ad-siRNAs. Four days after infection, recombinant RANKL is added to the wells (25 ng/ml, R&D systems). Medium is refreshed twice a week. Fourteen days after addition of RANKL, the differentiation of the monocytes towards osteoclasts is measured using one of the readouts described for the former assay setup. This assay allows the identification of factors that are indispensable for the response of osteoclast precursor cells to M-CSF or RANKL.

PBMC Isolation

PBMCs are obtained from peripheral blood (obtained from patients after informed consent) subjected to the following protocol. Blood is aseptically poured into 50 ml Falcon tubes and spun at 3000 g for 10 min at 25° C. The buffy coat is then collected and diluted 1:1 with PBS. The diluted buffy coat is poured on top of 20 ml Lymphoprep (Sigma) contained in a 50 ml Falcon tube. Upon centrifugation (35 min at 400 g at 25° C.), a white layer of mononuclear cells on top of the Lymphoprep is collected and washed twice with PBS (centrifugation at 200 g, 10 min, 25° C.) and rediluted in 7 ml PBS. This solution is pipetted onto a layer of 7 ml of hyperosmolar Percoll gradient contained in a 15 ml Falcon tube and centrifuged 35 min at 400 g at 25° C. The hyperosmolar Percoll gradient is prepared as follows: 1 volume of 1.5 M NaCl and 9 volumes of Percoll (Pharmacia, d=1,130 g/ml) are mixed. This mixture is added 1:1 to a PBS/Citrate buffer (NaH2PO4 1.49 mM, Na2HPO4 9.15 mM, NaCl 139.97 mM, Na-citrate (dihydrate) 13 mM, pH 7.2). After centrifugation, monocytes form a discrete ring on top of the gradient. Monocytes are collected and washed in culture medium. Cells are then ready to use in assays.

Example 9

Analysis of 'Off-target' Knock Down Effect

SiRNAs exert knock-down of gene expression through a recently discovered and partially understood mechanism. It is generally accepted that the specific annealing of the siRNA sequence to mRNA is responsible for a gene-specific 'on-target' knock-down. However, it cannot be excluded yet that limited mismatching between the siRNA and another mRNA can induce 'off-target' down-regulation of gene expression. In order to exclude that the knock-down of (an) 'off-target' mRNA(s) was responsible for the observed osteogenic effect, additional siRNAs/shRNAs were designed for 5 targets (Table 2B) that induced mineralization using stringent design criteria. The additional Ad-shRNAs were then tested in the BAP assay.

Galapagos has developed a proprietary algorithm that incorporates both published and proprietary design criteria (The Galapagos algorithms incorporates published criteria for siRNA design such as the Tuschl rules and rules from Reynolds et al. Nat. Biotechnol. 2004 March; 22(3):326-30) The latter include criteria such as low thermodynamic internal stability at the 5' antisense end of the RNAi sequence and 'GC content'). To address the question of possible 'off-target' effects, additional siRNA sequences were designed that:

align perfectly with the mRNA targeted by the original siRNA that may align imperfectly (maximum of 2 basepairs non-identity checked for every position of the 19mer) with a minimal number of 'off-target' mRNAs such that putative 'off-target' mRNAs were different from the putative 'off-target' mRNAs identified for the original siRNA putative 'off-target' mRNAs were different from the putative 'off-target' mRNAs identified for all original target siRNAs, except for the additional siRNAs designed for PPIA 7 additional siRNAs, designed for each of the 5 selected target genes were processed to derive recombinant adenoviruses. All siRNAs were sequenced upon cloning, to verify their identity and exclude errors due to the oligonucleotide synthesis.

34 Ad-shRNAS were successfully generated and tested in the BAP assay at 3 MOIs in 2 independent experiments, in parallel with the original 5 Ad-shRNAs.

Figure 9:
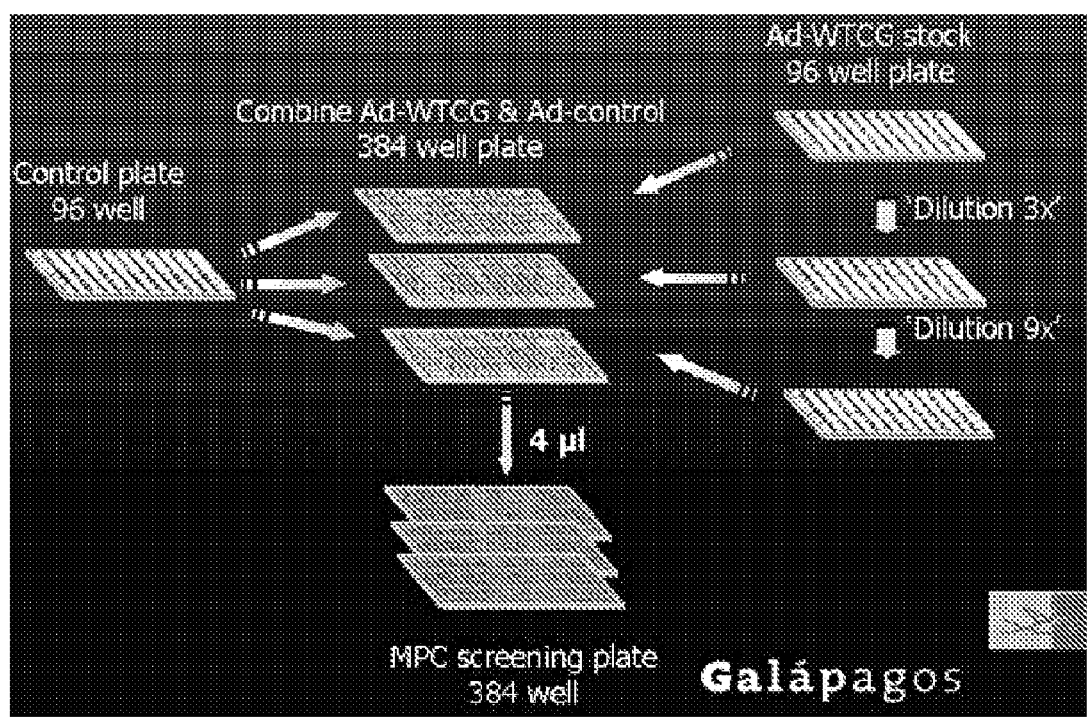

Recombinant adenoviruses encoding the designed shRNAs (Ad-shRNAs) were produced, titered, aliquoted in 96 well plates and stored at −80° C. These plates were processed in the primary BAP assay as follows:

MPC cells were seeded with a Multidrop 384 (Labsystems) in black 384 well plates with clear bottom (Costar or Nunc) in 60 µl MSC medium containing 10% fetal calf serum (FCS) (proprietary medium from Progentix, The Netherlands), at a density of 500 cells per well. One day later, a 96 well plate containing aliquoted Ad-shRNAs and another containing negative and positive control viruses (knock-down control plate, FIG. 3) were thawed and virus aliquots transferred to the MPC plate using a 96-channel dispenser (Tecan Freedom 200 equipped with a TeMO96 and a RoMa plate handler, Tecan AG, Switzerland) (FIG. 9). For the control plate, 1 µL virus stock (average titer of $2\times10^9$ viral particles per ml) was transferred to the 384 well screening plates. The Ad-shRNAs were screened at 3 multiplicities of infection (MOIs): 12,000, 4,000 and 1,333. Viruses were transferred from the 96 well stock plate to three 384 well screening plates (FIG. 9). Next, 5 µl of adenovirus expressing the human coxsackie and adenovirus receptor (hCAR) (AdC15-hCAR/AdC20-hCAR) was transferred into these wells (final MOI of 155) from a 96 well V-bottom plate with the aid of the 96-channel dispenser.

Plates were then incubated at 37° C., 10% $CO_2$ in a humidified incubator for four days. Four days post infection, the medium containing the adenoviruses was replaced by 60 µl fresh MSC medium containing 10% FCS free of virus. After an additional nine days of incubation, medium was removed, 15 µL of a 4-methylumbelliferylphosphate solution (Sigma, # M3168) was added to each well and the fluorescence of 4-methyl-umbelliferone released by the alkaline phosphatase activity was measured after 15 min incubation at 37° C. using a fluorimeter (excitation: 360 nm; emission: 440 nm; FluoStar, BMG).

All Ad-shRNAs viruses were screened in duplicate at 3 MOIs in two identical but independent screens. Thresholds were calculated for hit calling using either all negative controls present in one screening round ('Global' analysis) or using the negative controls present on one screening plate ('Local' analysis). Hits were called according to the following selection criteria:
1) BAP signals higher than the mean plus 3 times (μ+3σ) the standard deviation of negative controls. The two individual datapoints for each virus in the batch were analyzed independently.
2) Positive BAP signals as defined by criterion 1 where one Ad-shRNAs scores at least at one MOI in duplicate in at least one of the 2 screens.

A 'Global' analysis of the data identified 8 siRNAs targeting 5 loci and a 'Local' analysis' identified 9 siRNAs targeting 5 loci. The identity of the 5 selected genes is presented in Table 3 together with the final number of siRNAs that scored in the BAP assay. All original 5 Ad-shRNAs scored in the BAP assay based on both the 'Global' and 'Local' analysis.

TABLE 3

Identification of multiple siRNAs for selected validated targets in the BAP assay.

| Gene ID | Global analysis - Redundancy | Local analysis - Redundancy |
|---|---|---|
| AGTRL1 | 2 | 3 |
| DRD5 | 3 | 3 |
| ENSG00000172441 | 2 | 2 |
| GPR39 | 3 | 3 |
| PDE11A | 3 | 3 |

In Table 3, the numbers indicate all siRNAs that scored in the BAP assay, including the original 5 siRNAs.

In conclusion, additional Ad-shRNAs targeting 5 selected targets were designed and constructed. Negative controls present on the control plates were used per plate ('Local' analysis) or per batch of plates ('Global' analysis) to determine the cutoff for hit calling (μ+3σ).
- the 'Global' analysis resulted in 8 viruses that scored positive in the BAP assay, confirming 5 of the 5 validated targets
- the 'Local' analysis resulted in 9 viruses that scored positive in the BAP assay, confirming 5 of the 5 validated targets
- All original 5 Ad-shRNA viruses scored in the BAP assay when using either the 'Global' or the 'Local' analysis.

TABLE 2A

Lists the polypeptides, polynucleotides and knock-down constructs of the present invention.

| | | | | | | SEQ ID NO | | | Score in Mineralisation assay as described in Example 6 |
|---|---|---|---|---|---|---|---|---|---|
| Hit ID | KD Target Sequence | Target Gene Symbol | GenBank Accession | Name | KD construct | Polynucleotide | Polypeptide | | |
| H24-229 | TGCAGGCCCT GCCATTGTC | SLC7A1 | NM_003045 | Solute carrier family 7 (cationic amino acid transporter, y+ system), member 1 | 1 | 78 | 194 | | |
| H24-230 | GAAGATTACAG GCGAGATC | PDLIM7 | NM_005451-NM_203350-NM_203353 | MDZ and LIM domain 7(enigma) | 2 | 79-81 | 195-197 | | |
| H24-231 | CTCTGGAAGG AGTCATTAC | RAD50 | NM_005732 | RAD50 homolog (S. cerevisiae) (RAD50), transcript variant 1 | 3 | 82 | 198 | | |
| H24-233 | CACTAAGGTG CAGTGCTAC | AGTRL1 | NM_005161 | angiotensin II receptor-like 1 | 4 | 83 | 199 | X | |
| H24-235 | GGTGTACTTCA CCAACGCC | SCN4A | NM_000334 | sodium channel, voltage-gated, type IV, alpha | 5 | 84 | 200 | | |
| H24-236 | GCTTCTGAAGA CCACAGTC | KCNJ1 | NM_000220-NM_153764-NM_153765-NM_153766-NM_153767 | potassium inwardly-rectifying channel, subfamily J, member 1 | 6 | 85-89 | 201-205 | | |
| H24-237 | CTACCTGCTG GAGAACTTC | ENTPD2 | NM_001246-NM_203468 | ectonucleoside triphosphate diphosphohydrolase 2 | 7 | 90-91 | 206-207 | | |
| H24-238 | TGGCACAGTG ATCGTGGAC | CLCA1 | NM_001285 | chloride channel, calcium activated, family member 1 | 8 | 92 | 208 | | |
| H24-239 | CCTGTTCAGAA CGATGGGC | CLCN6 | NM_001286 | chloride channel 6 (CLCN6), transcript variant ClC-6a | 9 | 93 | 209 | | |
| H24-241 | TTGCGCCAGG AGATACCTC | BMP3 | NM_001201 | bone morphogenetic protein 3 (osteogenic) (BMP3) | 10 | 94 | 210 | X | |

TABLE 2A-continued

Lists the polypeptides, polynucleotides and knock-down constructs of the present invention.

| Hit ID | KD Target Sequence | Target Gene Symbol | GenBank Accession | Name | SEQ ID NO KD construct | SEQ ID NO Polynucleotide | SEQ ID NO Polypeptide | Score in Mineralisation assay as described in Example 6 |
|---|---|---|---|---|---|---|---|---|
| H24-242 | CGCCTTCAAAGAGAAATTC | ABCA5 | NM_018672-NM_172232 | ATP-binding cassette, sub-family A (ABC1), member 5 | 11 | 95-96 | 211-212 | |
| H24-243 | CTCTCTGTGGTCAACACGC | SLC2A7 | NM_207420 | Solute carrier family 2 (facilitated glucose transporter), member 7 | 12 | 97 | 213 | |
| H24-244 | GGAAGGGTATCTGGAAGCC | GPD2 | NM_000408 | glycerol-3-phosphate dehydrogenase 2 (mitochondrial) | 13 | 98 | 214 | |
| H24-245 | CAGCAGGAAGGAGATTCAC | GALNTL2 | NM_054110 | UDP-N-acetyl-alpha-D-galactosamine:polypeptide N-acetylgalactosaminyl transferase-like 2 | 14 | 99 | 215 | X |
| H24-246 | GCACCTGCACTTGCTCGAC | B3Gn-T6 | NM_138706 | beta-1,3-N-acetylglucosaminyltransferase protein (B3Gn-T6) | 15 | 100 | 216 | X |
| H24-247 | GTTGACTAATCCTCCTTCC | LOC257478 | XM_054745 | similar to Neurogenic locus notch homolog protein 1 precursor (Notch 1) (hN1) (Translocation-associated notch protein TAN-1) | 16 | 101 | 217 | |
| H24-248 | CATGGAGTGCTCTAGATCC | LOC254325 | XM_172351 | similar to peptidylprolyl isomerase A (cyclophilin A) | 17 | 102 | 218 | |
| H24-249 | TCGAAGAGGTGCCGACCAC | NETO1 | NM_138966-NM_153181 | neuropilin (NRP) and tolloid (TLL)-like 1 | 18 | 103-104 | 219-220 | |
| H24-250 | TTGGACAAATCAGGGTCTC | PPP3R2 | NM_147180 | protein phosphatase 3 (formerly 2B), regulatory subunit B (19 kD), beta isoform (calcineurin B, type II) | 19 | 105 | 221 | |
| H24-251 | TCCAGAGTACTTCAGCGCC | INSRR | NM_014215-XM_043563 | insulin receptor-related receptor | 20 | 106-107 | 222-223 | |
| H24-252 | CCAATTTGCCTGTAGTGCC | GPR145 | NM_032503 | G protein-coupled receptor 145 | 21 | 108 | 224 | |
| H24-253 | GTGGAAGGCGATGCACAAC | CTSL | NM_001912-NM_145918 | cathepsin L | 22 | 109-110 | 225-226 | |
| H24-254 | CTTGTGGACAGGCCAGATC | LOC126767 | XM_060167 | similar to arylacetamide deacetylase (esterase) | 23 | 111 | 227 | |
| H24-255 | GCATGAGTTTCTGACCAGC | SMOC2 | NM_022138 | SPARC related modular calcium binding 2 | 24 | 112 | 228 | |
| H24-256 | CTATTGTTCCAGTGGAGGC | LOC159121 | XM_099028 | LOC159121 | 25 | 113 | 229 | X |
| H24-257 | GTTTAAGGCAGCCAACATC | PDE11A | NM_016953 | phosphodiesterase 11A | 26 | 114 | 230 | X |
| H24-259 | CTTAGTTTCCAGCAGGACC | STK19 | NM_004197-NM_032454 | Serine/threonine kinase 19 | 27 | 115-116 | 231-232 | |
| H24-260 | GATCGGGTTCCACCTGTCC | SLC9A3 | NM_004174 | solute carrier family 9 (sodium/hydrogen exchanger), isoform 3 | 28 | 117 | 233 | |
| H24-261 | TTTGTGGTGTGCATGGCTC | HTR3A | NM_000869-NM_213621 | 5-hydroxytryptamine (serotonin) receptor 3A | 29 | 118-119 | 234-235 | |

TABLE 2A-continued

Lists the polypeptides, polynucleotides and knock-down constructs of the present invention.

| Hit ID | KD Target Sequence | Target Gene Symbol | GenBank Accession | Name | SEQ ID NO KD construct | SEQ ID NO Polynucleotide | SEQ ID NO Polypeptide | Score in Mineralisation assay as described in Example 6 |
|---|---|---|---|---|---|---|---|---|
| H24-262 | TGCCAGCACCATTCGAAGC | SLC9A1 | NM_003047 | solute carrier family 9 (sodium/hydrogen exchanger), isoform 1 (antiporter, Na+/H+, amiloride sensitive) | 30 | 120 | 236 | |
| H24-263 | GTCCGAGAGCGAAGAGAGC | GPR39 | NM_001508 | G protein-coupled receptor 39 | 31 | 121 | 237 | X |
| H24-264 | GCAGGTGAAGAAGATCGAC | ADRB1 | NM_000684 | adrenergic, beta-1-, receptor | 32 | 122 | 238 | |
| H24-265 | TAAGATTGAAGGGCTGGAC | EPHX1 | NM_000120 | epoxide hydrolase 1, microsomal (xenobiotic) | 33 | 123 | 239 | |
| H24-266 | GGGTGTGGTCTGAATTACC | PRKD1 | NM_002742 | protein kinase D1 | 34 | 124 | 240 | |
| H24-267 | CATCTTGCATGAGATTGAC | KCNJ12 | NM_021012 | potassium inwardly-rectifying channel, subfamily J, member 12 | 35 | 125 | 241 | |
| H24-268 | GAGATCCGGGAGAGAAATC | AFG3L2 | NM_006796 | AFG3 ATPase family gene 3-like 2 (yeast) | 36 | 126 | 242 | |
| H24-269 | GTGCCGGATGCGCATCTTC | SLC12A4 | NM_005072 | solute carrier family 12 (potassium/chloride transporters), member 4 | 37 | 127 | 243 | |
| H24-270 | TACCAGTATGGTGGCAACC | ENTPD5 | NM_001249 | ectonucleoside triphosphate diphosphohydrolase 5 | 38 | 128 | 244 | |
| H24-271 | GGGCTTCGTTTCTGCTCTC | KCNK4 | NM_016611-NM_033310-NM_033311 | potassium channel, subfamily K, member 4 | 39 | 129-131 | 245-247 | |
| H24-272 | GCAAGTTCACTACAGCATC | MAP2K6 | NM_002758-NM_031988 | mitogen-activated protein kinase kinase 6 | 40 | 132-133 | 248-249 | X |
| H24-273 | CTGTGCAGCTGCAGGGAAC | TIE1 | NM_005424 | tyrosine kinase with immunoglobulin-like and EGF-like domains 1 | 41 | 134 | 250 | |
| H24-274 | TTGGAACAGCTGGACCAGC | ABCC11 | NM_032583-NM_033151-NM_145186 | ATP-binding cassette, sub-family C (CFTR/MRP), member 11 | 42 | 135-137 | 251-253 | |
| H24-275 | CCAGGATGTAATCAATGCC | EPHB2 | NM_004442-NM_017449 | EPH receptor B2 | 43 | 138-139 | 254-255 | |
| H24-276 | ACTCTCCGAAAGCATGGCC | LOC137057 | XM_059898 | similar to hypothetical protein FLJ10661 | 44 | 140 | 256 | |
| H24-277 | CGGAATGCAAGGAGATTGC | SLC39A12 | NM_152725 | Solute carrier family 39 (zinc transporter), member 12 | 45 | 141 | 257 | |
| H24-278 | GCTTCCAAGGAGCAGGTTC | HS3ST5 - LOC222537 | NM_153612-XM_167035 | Heparan sulphate (glucosamine) 3-O-sulfotransferase 5/ similar to heparan sulfate D-glucosaminyl 3-O-sulfotransferase 1 precursor; heparin-glucosamine 3-O-sulfotransferase | 46 | 142-143 | 258-259 | X |
| H24-279 | ATATACATTTCACCCTAGC | LOC168415-LOC256726 | XM_095086-XM_172596 | similar to NADH dehydrogenase subunit 4L | 47 | 144-145 | 260-261 | |
| H24-280 | TCCCGCACTTGCCGAAGTC | ENSG00000172441 | ENSG00000172441 | Annotated using proprietary algorithms | 48 | 146 | 262 | X |

TABLE 2A-continued

Lists the polypeptides, polynucleotides and knock-down constructs of the present invention.

| Hit ID | KD Target Sequence | Target Gene Symbol | GenBank Accession | Name | SEQ ID NO KD construct | SEQ ID NO Poly-nucleotide | SEQ ID NO Polypeptide | Score in Mineralisation assay as described in Example 6 |
|---|---|---|---|---|---|---|---|---|
| H24-281 | TGCAAACGGC ATTTCATCC | FOLR1 | NM_000802-NM_016724-NM_016725-NM_016729-NM_016730-NM_016731 | folate receptor 1 (adult) | 49 | 147-152 | 263-268 | |
| H24-282 | CATCTTGCTGA ACCTGGAC | SLC26A6 | NM_022911-NM_134263-NM_134426 | solute carrier family 26, member 6 | 50 | 153-155 | 269-271 | |
| H24-283 | ATTAATGACCT CACAGACC | SLC15A1 | NM_005073 | solute carrier family 15 (oligopeptide transporter), member 1 | 51 | 156 | 272 | |
| H24-284 | TGTCCAGGGA TATTGTGTC | ENSG00000124860 KIAA1639 - Obscn | ENSG00000124860-XM_290923-SK601 | KIAA1639 protein | 52 | 157-159 | 273-275 | |
| H24-285 | GTGTCATGAG CTACCTTAC | KCNS3 | NM_002252 | potassium voltage-gated channel, delayed-rectifier, subfamily S, member 3 | 53 | 160 | 276 | |
| H24-286 | TGTGCTCAAAT GACACCTC | SCNN1G | NM_001039 | sodium channel, nonvoltage-gated 1, gamma | 54 | 161 | 277 | |
| H24-287 | GGGTAGTCAG TACTGGCGC | VTN | NM_000638 | vitronectin (serum spreading factor, somatomedin B, complement S-protein) | 55 | 162 | 278 | |
| H24-288 | ACGTTTGGATA AAGTTGGC | LOC163812 | XM_089158 | similar to ALCOHOL DEHYDROGENASE CLASS III CHI CHAIN (GLUTATHIONE-DEPENDENT FORMALDEHYDE DEHYDROGENASE) (FDH) | 56 | 163 | 279 | |
| H24-289 | TGAGCAGTTG AAGAAGACC | NRD1 | NM_002525 | nardilysin (N-arginine dibasic convertase) | 57 | 164 | 280 | |
| H24-290 | ACAACCTGGC CAACTGGAC | DRD5 | NM_000798 | dopamine receptor D5 | 58 | 165 | 281 | X |
| H24-291 | GATCCAAGAG GCCCTGCAC | RASSF1 | NM_007182-NM_170712-NM_170713-NM_170714-NM_170715-NM_170716-NM_170717 | Ras association (RalGDS/AF-6) domain family 1 | 59 | 166-172 | 282-288 | |
| H24-292 | CCCATACTGTG GAGAAATC | ZNF354A | NM_005649 | Zinc finger protein 354A | 60 | 173 | 289 | |
| H24-293 | GCGACTGGTG AGCGAGATC | OLIG2 | NM_005806 | oligodendrocyte lineage transcription factor 2 | 61 | 174 | 290 | |
| H24-294 | TGGTTCTCTTC CCGACTGC | PIK3R4 | NM_014602 | Phosphoinositide-3-kinase, regulatory subunit 4, p150 | 62 | 175 | 291 | |
| H24-295 | AATCTTGTGCC AAAGAGGC | PCM1 | NM_006197 | pericentriolar material 1 | 63 | 176 | 292 | |
| H24-296 | ATGCCAGACA ATGCAGTGC | LOC389873 - SEPHS1 | XM_372233-NM_012247 | Selenophosphate synthetase 1 | 64 | 177-178 | 293-294 | |
| H24-297 | GAGCAGACAA ACGAAGGGC | KCND2 | NM_012281 | potassium voltage-gated channel, Shal-related subfamily, member 2 | 65 | 179 | 295 | |

TABLE 2A-continued

Lists the polypeptides, polynucleotides and knock-down constructs of the present invention.

| Hit ID | KD Target Sequence | Target Gene Symbol | GenBank Accession | Name | SEQ ID NO KD construct | SEQ ID NO Poly-nucleotide | SEQ ID NO Polypeptide | Score in Mineral-isation assay as described in Example 6 |
|---|---|---|---|---|---|---|---|---|
| H24-298 | CTGTTCAGCAGTGGCCGAC | TNFRSF25 | NM_003790-NM_148965-NM_148966-NM_148967-NM_148968-NM_148969-NM_148971-NM_148972-NM_148973-NM_148974 | tumor necrosis factor receptor superfamily, member 25 | 66 | 180-189 | 296-305 | X |
| H24-299 | ATGGCACTGTGTGGACTGC | USP44 | NM_032147 | Ubiquitin specific protease 44 | 67 | 190 | 306 | |
| H24-300 | GATCTCCACTGAGGACATC | PCTK1 | NM_006201-NM_033018-NM_033019 | PCTAIRE protein kinase 1 | 68 | 191-193 | 307-309 | |

TABLE 2B

Addition to the summary of polynucleotides, polypeptides and knock-down constructs of the invention.

| KD Target Sequence | Target Gene Symbol | GenBank Accession | Name | SEQ ID NO KD construct | SEQ ID NO Polynucleotide | SEQ ID NO Polypeptide |
|---|---|---|---|---|---|---|
| CACCACTAAGGTGCAGTGC | AGTRL1 | NM_005161 | angiotensin receptor-like 1 | 69 | 83 | 199 |
| CACGTACCGGGACTATGAC | AGTRL1 | NM_005161 | angiotensin receptor-like 1 | 70 | 83 | 199 |
| CGTGTGTCAGCTGATGTTC | PDE11A | NM_016953 | Phosphodiesterase 11A | 71 | 114 | 230 |
| CACCAGTGGTGAAATTTAC | PDE11A | NM_016953 | Phosphodiesterase 11A | 72 | 114 | 230 |
| CCTCAGCTCGGTCATCAAC | GPR39 | NM_001508 | G protein-coupled receptor 39 | 73 | 121 | 237 |
| TATTCTGGTGTACCTGATC | GPR39 | NM_001508 | G protein-coupled receptor 39 | 74 | 121 | 237 |
| TACGTTCTACTGAAGGCCC | ENSG00000172441 | ENSG00000172441 | Annotated using proprietary algorithms | 75 | 146 | 262 |
| ACTTTCAGAAGGTGTTTGC | DRD5 | NM_000798 | Dopamine receptor D5 | 76 | 165 | 281 |
| CTTCCATCAAGAAGGAGAC | DRD5 | NM_000798 | Dopamine receptor D5 | 77 | 165 | 281 |

SEQUENCE LISTING (316 sequences)

SEQ ID NO: 1 - DNA, 19 bp, Artificial Sequence
  Synthetic oligonucleotide
tgcaggccctgccattgtc

SEQ ID NO: 2 - DNA, 19 bp, Artificial Sequence
  Synthetic oligonucleotide
gaagattacaggcgagatc

SEQ ID NO: 3 - DNA, 19 bp, Artificial Sequence
  Synthetic oligonucleotide
ctctggaaggagtcattac

SEQ ID NO: 4 - DNA, 19 bp, Artificial Sequence
  Synthetic oligonucleotide
cactaaggtgcagtgctac

SEQ ID NO: 5 - DNA, 19 bp, Artificial Sequence
  Synthetic oligonucleotide
ggtgtacttcaccaacgcc

SEQ ID NO: 6 - DNA, 19 bp, Artificial Sequence
  Synthetic oligonucleotide
gcttctgaagaccacagtc

SEQ ID NO: 7 - DNA, 19 bp, Artificial Sequence
  Synthetic oligonucleotide
ctacctgctggagaacttc

SEQ ID NO: 8 - DNA, 19 bp, Artificial Sequence
  Synthetic oligonucleotide
tggcacagtgatcgtggac

SEQ ID NO: 9 - DNA, 19 bp, Artificial Sequence
  Synthetic oligonucleotide
cctgttcagaacgatgggc

SEQ ID NO: 10 - DNA, 19 bp, Artificial Sequence
  Synthetic oligonucleotide
ttgcgccaggagatacctc

SEQ ID NO: 11 - DNA, 19 bp, Artificial Sequence
  Synthetic oligonucleotide
cgccttcaaagagaaattc

SEQ ID NO: 12 - DNA, 19 bp, Artificial Sequence
  Synthetic oligonucleotide
ctctctgtggtcaacacgc

SEQ ID NO: 13 - DNA, 19 bp, Artificial Sequence
  Synthetic oligonucleotide
ggaagggtatctggaagcc

SEQ ID NO: 14 - DNA, 19 bp, Artificial Sequence
  Synthetic oligonucleotide
cagcaggaaggagattcac

SEQ ID NO: 15 - DNA, 19 bp, Artificial Sequence
  Synthetic oligonucleotide
gcacctgcacttgctcgac

SEQ ID NO: 16 - DNA, 19 bp, Artificial Sequence
  Synthetic oligonucleotide
gttgactaatcctccttcc

SEQ ID NO: 17 - DNA, 19 bp, Artificial Sequence
  Synthetic oligonucleotide
catggagtgctctagatcc

SEQ ID NO: 18 - DNA, 19 bp, Artificial Sequence
  Synthetic oligonucleotide
tcgaagaggtgccgaccac

SEQ ID NO: 19 - DNA, 19 bp, Artificial Sequence
  Synthetic oligonucleotide
ttggacaaatcagggtctc

SEQ ID NO: 20 - DNA, 19 bp, Artificial Sequence
  Synthetic oligonucleotide
tccagagtacttcagcgcc

SEQ ID NO: 21 - DNA, 19 bp, Artificial Sequence
  Synthetic oligonucleotide
ccaatttgcctgtagtgcc

SEQ ID NO: 22 - DNA, 19 bp, Artificial Sequence
  Synthetic oligonucleotide
gtggaaggcgatgcacaac

SEQ ID NO: 23 - DNA, 19 bp, Artificial Sequence
  Synthetic oligonucleotide
cttgtggacaggccagatc

SEQ ID NO: 24 - DNA, 19 bp, Artificial Sequence
  Synthetic oligonucleotide
gcatgagtttctgaccagc

SEQ ID NO: 25 - DNA, 19 bp, Artificial Sequence
  Synthetic oligonucleotide
ctattgttccagtggaggc

SEQ ID NO: 26 - DNA, 19 bp, Artificial Sequence
  Synthetic oligonucleotide
gtttaaggcagccaacatc

SEQ ID NO: 27 - DNA, 19 bp, Artificial Sequence
  Synthetic oligonucleotide
cttagtttccagcaggacc

SEQ ID NO: 28 - DNA, 19 bp, Artificial Sequence
  Synthetic oligonucleotide
gatcgggttccacctgtcc

SEQ ID NO: 29 - DNA, 19 bp, Artificial Sequence
  Synthetic oligonucleotide
tttgtggtgtgcatggctc

SEQ ID NO: 30 - DNA, 19 bp, Artificial Sequence
  Synthetic oligonucleotide
tgccagcaccattcgaagc

SEQ ID NO: 31 - DNA, 19 bp, Artificial Sequence
  Synthetic oligonucleotide
gtccgagagcgaagagagc

SEQ ID NO: 32 - DNA, 19 bp, Artificial Sequence
  Synthetic oligonucleotide
gcaggtgaagaagatcgac

SEQ ID NO: 33 - DNA, 19 bp, Artificial Sequence
  Synthetic oligonucleotide
taagattgaagggctggac

SEQ ID NO: 34 - DNA, 19 bp, Artificial Sequence
  Synthetic oligonucleotide
gggtgtggtctgaattacc

SEQ ID NO: 35 - DNA, 19 bp, Artificial Sequence
  Synthetic oligonucleotide
catcttgcatgagattgac

SEQ ID NO: 36 - DNA, 19 bp, Artificial Sequence
  Synthetic oligonucleotide
gagatccgggagagaaatc

SEQ ID NO: 37 - DNA, 19 bp, Artificial Sequence
  Synthetic oligonucleotide
gtgccggatgcgcatcttc

SEQ ID NO: 38 - DNA, 19 bp, Artificial Sequence
  Synthetic oligonucleotide
taccagtatggtggcaacc

SEQ ID NO: 39 - DNA, 19 bp, Artificial Sequence
  Synthetic oligonucleotide
gggcttcgtttctgctctc

SEQ ID NO: 40 - DNA, 19 bp, Artificial Sequence
  Synthetic oligonucleotide
gcaagttcactacagcatc

SEQ ID NO: 41 - DNA, 19 bp, Artificial Sequence
  Synthetic oligonucleotide
ctgtgcagctgcagggaac

SEQ ID NO: 42 - DNA, 19 bp, Artificial Sequence
  Synthetic oligonucleotide
ttggaacagctggaccagc

SEQ ID NO: 43 - DNA, 19 bp, Artificial Sequence
  Synthetic oligonucleotide
ccaggatgtaatcaatgcc

SEQ ID NO: 44 - DNA, 19 bp, Artificial Sequence
  Synthetic oligonucleotide
actctccgaaagcatggcc

SEQ ID NO: 45 - DNA, 19 bp, Artificial Sequence
  Synthetic oligonucleotide
cggaatgcaaggagattgc

SEQ ID NO: 46 - DNA, 19 bp, Artificial Sequence
  Synthetic oligonucleotide
gcttccaaggagcaggttc

SEQ ID NO: 47 - DNA, 19 bp, Artificial Sequence
  Synthetic oligonucleotide
atatacatttcaccctagc

SEQ ID NO: 48 - DNA, 19 bp, Artificial Sequence
  Synthetic oligonucleotide
tcccgcacttgccgaagtc

SEQ ID NO: 49 - DNA, 19 bp, Artificial Sequence
  Synthetic oligonucleotide
tgcaaacggcatttcatcc

SEQ ID NO: 50 - DNA, 19 bp, Artificial Sequence
  Synthetic oligonucleotide
catcttgctgaacctggac

SEQ ID NO: 51 - DNA, 19 bp, Artificial Sequence
  Synthetic oligonucleotide
attaatgacctcacagacc

SEQ ID NO: 52 - DNA, 19 bp, Artificial Sequence
  Synthetic oligonucleotide
tgtccagggatattgtgtc

SEQ ID NO: 53 - DNA, 19 bp, Artificial Sequence
  Synthetic oligonucleotide
gtgtcatgagctaccttac

SEQ ID NO: 54 - DNA, 19 bp, Artificial Sequence
  Synthetic oligonucleotide
tgtgctcaaatgacacctc

SEQ ID NO: 55 - DNA, 19 bp, Artificial Sequence
  Synthetic oligonucleotide
gggtagtcagtactggcgc

SEQ ID NO: 56 - DNA, 19 bp, Artificial Sequence
  Synthetic oligonucleotide
acgtttggataaagttggc

SEQ ID NO: 57 - DNA, 19 bp, Artificial Sequence
  Synthetic oligonucleotide
tgagcagttgaagaagacc

SEQ ID NO: 58 - DNA, 19 bp, Artificial Sequence
  Synthetic oligonucleotide
acaacctggccaactggac

SEQ ID NO: 59 - DNA, 19 bp, Artificial Sequence
  Synthetic oligonucleotide
gatccaagaggccctgcac

SEQ ID NO: 60 - DNA, 19 bp, Artificial Sequence
  Synthetic oligonucleotide
cccatactgtggagaaatc

SEQ ID NO: 61 - DNA, 19 bp, Artificial Sequence
  Synthetic oligonucleotide
gcgactggtgagcgagatc

SEQ ID NO: 62 - DNA, 19 bp, Artificial Sequence
  Synthetic oligonucleotide
tggttctcttcccgactgc

SEQ ID NO: 63 - DNA, 19 bp, Artificial Sequence
  Synthetic oligonucleotide
aatcttgtgccaaagaggc

SEQ ID NO: 64 - DNA, 19 bp, Artificial Sequence
  Synthetic oligonucleotide
atgccagacaatgcagtgc

SEQ ID NO: 65 - DNA, 19 bp, Artificial Sequence
  Synthetic oligonucleotide
gagcagacaaacgaagggc

SEQ ID NO: 66 - DNA, 19 bp, Artificial Sequence
  Synthetic oligonucleotide
ctgttcagcagtggccgac

SEQ ID NO: 67 - DNA, 19 bp, Artificial Sequence
  Synthetic oligonucleotide
atggcactgtgtggactgc

SEQ ID NO: 68 - DNA, 19 bp, Artificial Sequence
  Synthetic oligonucleotide
gatctccactgaggacatc

SEQ ID NO: 69 - DNA, 19 bp, Artificial Sequence
  Synthetic oligonucleotide
caccactaaggtgcagtgc

SEQ ID NO: 70 - DNA, 19 bp, Artificial Sequence
  Synthetic oligonucleotide
cacgtaccgggactatgac

SEQ ID NO: 71 - DNA, 19 bp, Artificial Sequence
  Synthetic oligonucleotide
cgtgtgtcagctgatgttc

SEQ ID NO: 72 - DNA, 19 bp, Artificial Sequence
  Synthetic oligonucleotide
caccagtggtgaaatttac

SEQ ID NO: 73 - DNA, 19 bp, Artificial Sequence
  Synthetic oligonucleotide
cctcagctcggtcatcaac

SEQ ID NO: 74 - DNA, 19 bp, Artificial Sequence
  Synthetic oligonucleotide
tattctggtgtacctgatc

SEQ ID NO: 75 - DNA, 19 bp, Artificial Sequence
  Synthetic oligonucleotide
tacgttctactgaaggccc

SEQ ID NO: 76 - DNA, 19 bp, Artificial Sequence
  Synthetic oligonucleotide
actttcagaaggtgtttgc

SEQ ID NO: 77 - DNA, 19 bp, Artificial Sequence
  Synthetic oligonucleotide
cttccatcaagaaggagac

SEQ ID NO: 78 - DNA, 7248 bp, Homo sapiens
gcggccgcgggctcccgctaaccgcagcctccactcctctccccgcgcgccgcgcccccgccccgccccgcccggtctcgccggccgagcgtccgttggtccttgagcgcgtccgacagtctgtctgttcgcgatcctgccggagccccgccgccgccggcttggattctgaaaccttccttgtatccctcctgagacatctttgctgcaagatcgaggctgtcctctggtgagaaggtggtgaggcttcccgtcatattccagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggacttttaactcttggtgtgaaagagtcggccatggtcaacaaaatattcacttgtattaacgtcctggtcctgggcttcataatggtgtcaggatttgtgaaaggatcggttaaaaactggcagctcacggaggaggattttgggaacacatcaggccgtctctgtttgaacaatgacacaaaagaagggaagcccggtgttggtggattcatgcccttcgggttctctggtgtcctgtcgggggcagcgacttgcttctatgccttcgtgggctttgactgcatcgccaccacaggtgaagaggtgaagaacccacagaaggccatccccgtggggatcgtggcgtccctcttgatctgcttcatcgcctactttggggtgtcggctgccctcacgctcatgatgccctacttctgcctggacaataacagccccctgcccgacgcctttaagcacgtgggctgggaaggtgccaagtacgcagtggccgtgggctccctctgcgctctttccgccagtcttctaggttccatgtttcccatgcctcgggttatctatgccatggctgaggatggactgctatttaaattcttagccaacgtcaatgataggaccaaaacaccaataatcgccacattagcctcgggtgccgttgctgctgtgatggccttcctctttgacctgaaggacttggtggacctcatgtccattggcactctcctggcttactcgttggtggctgcctgtgtgttggtcttacggtaccagccagagcagcctaacctggtataccagatggccagtacttccgacgagttagatccagcagaccaaaatgaattggcaagcaccaatgattcccagctggggtttttaccagaggcagagatgttctctttgaaaaccatactctcacccaaaaacatggagccttccaaaatctctgggctaattgtgaacatttcaaccagccttatagctgttctcatcatcaccttctgcattgtgaccgtgcttggaagggaggctctcaccaaaggggcgctgtgggcagtctttctgctcgcagggtctgccctcctctgtgccgtggtcacgggcgtcatctggaggcagcccgagagcaagaccaagctctcatttaaggttcccttcctgccagtgctccccatcctgagcatcttcgtgaacgtctatctcatgatgcagctggaccagggcacctgggtccggtttgctgtgtggatgctgataggcttcatcatctactttggctatggcctgtggcacagcgaggaggcgtccctggatgccgaccaagcaaggactcctgacggcaacttggaccagtgcaagtgacgcacagccccgccccccggaggtggcagcagccccgagggacgcccccagaggaccgggaggcaccccaccctccccaccagtgcaacagaaaccacctgcgtccacaccctcactgcagccaaaggtgcaattacttgacctgcagccccagcccaccctcggctctgcagccggttctccgggccctggtcacctccagacagctgcctggccggggccactaggctgcggctggccactgtgtctcctcacttctctgaacaaagcagttcctcccctaccagctcagccccgagctgccgcagcctcaggcagaacggaggtcaccttctctccttatcttgggaaccaggccttcctcccggggactgttctgggattgaaattgtgcatactccaaactttcgcagccatcttcccgctcagccccagacacccagcaatcaagccagatgagtaccacaaaacagtgtgtccccagcagctccccaccccagagccaaatgacagtagtgcacttaaaaaggaaaatcaggcctgttgtccttctccggttgcattcagatgggtcattagggccggaccctgcctgccccttggcttctcagggctttgctctgacaccatgacagctgcccggggctgagggcagctggctccactcaaatgaggaagaagggatcactcccattagggcctgctttgcttatgcatgtgtgtgcacatgcatgtaaaccagggaccttcagctcacggcctccaggcctgggccagttcttgctgctcctgccgtctcccccgactggctgtgtcctgagtaactggaacatgagacagtatctgcaggactggccccatggtggccgagtcagaagtctgtttcctgtgagtcgccaccgttcactcagtcttgccctcccatgctttggagccagtctggtggctcctgtaaggttctcaaggctggtggcagctcagtctggggtcaggacatgtcggggtcatgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaa

SEQ ID NO: 79 - DNA, 1709 bp, Homo sapiens
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 80 - DNA, 1607 bp, Homo sapiens
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggtgcagacccctgacaaacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 81 - DNA, 1726 bp, Homo sapiens
agaacactggcggccgatcccaacgaggctccctggagcccgacgcagagcagcgccctggccgggccaagcaggagccggcatcatggattccttcaaagtagtgctggaggggccagcaccttggggcttccggctgcaagggggcaaggacttcaatgtgcccctctccatttcccggctcactcctgggggcaaagcggcgcaggccggagtggccgtgggtgactgggtgctgagcatcgatggcgagaatgcgggtagcctcacacacatcgaagctcagaacaagatccgggcctgcggggagcgcctcagcctgggcctcagcagggcccagccggttcagagcaaaccgcagaaggcctccgcccccgccgcggaccctccgcggtacacctttgcacccagcgtctccctcaacaagacggcccggccctttggggcgcccccgcccgctgacagcgccccgcagcagaatgggtgcagacccctgacaaacagccgctccgaccgctggtcccagatgccagcaagcagcggctgatggagaacacagaggactggcggccgcggccggggacaggccagtcgcgttccttccgcatccttgcccacctcacaggcaccgagttcatgcaagacccggatgaggagcacctgaagaaatcaagccaggtgcccaggacagaagccccagccccagcctcatctacaccccaggagccctggcctggccctaccgcccccagccctaccagccgcccgccctgggctgtggaccctgcgtttgccgagcgctatgccccggacaaaacgagcacagtgctgacccggcacagccagccggccacgcccacgccgctgcagagccgcacctccattgtgcaggcagctgccggaggggtgccaggagggggcagcaacaacggcaagactcccgtgtgtcaccagtgccacaaggtcatccggggccgctacctggtggcgctgggccacgcgtaccacccggaggagtttgtgtgtagccagtgtgggaaggtcctggaagagggtggcttctttgaggagaagggcgccatcttctgcccaccatgctatgacgtgcgctatgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctgcttcgtctgtgcgatatgtcagatcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgccttaaccctggctcctggcccgagcctggggctccctgggccctgccccacccaccttatcctcccaccccactccctccaccaccacagcacaccggtgctggccacaccagccccctttcacctccagtgccacaataaacctgtacccagctgtg

SEQ ID NO: 82 - DNA, 5891 bp, Homo sapiens
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaaaaaaaaaaaaaaaaaaaaaaaa

SEQ ID NO: 83 - DNA, 1833 bp, Homo sapiens
ggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggcaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaactgttgtgtccaaaaaaaaaaaaaaaaaaaaaaaaaaaaaaa

SEQ ID NO: 84 - DNA, 7823 bp, Homo sapiens
ccagcaccccggggctgcgcactgcagctccccaggccacccaccacccttctggtctctgagcccaggatgcgaggatggccagaccatctctgtgcaccctggctcgtctgggccctgagtgcttgcgccccttcacccgggagtcactggcagccatagaacagcgggcggtggaggaggaggcccggctgcagcggaataagcagatggagattgaggagcccgaacggaagccacgaagtgacttggaggctggcaagaacctacccatgatctacggagaccccccgccggaggtcatcggcatccccctggaggacctggatccctactacagcaataagaagaccttcatcgtactcaacaagggcaaggccatcttccgcttctccgccacacctgctctctacctgctgagccccttcagcgtagtcaggcgcggggccatcaaggtgctcatccatgcgctgttcagcatgttcatcatgatcaccatcttgaccaactgcgtattcatgaccatgagtgacccgcctccctggtccaagaatgtggagtacaccttcacagggatctacacctttgagtccctcatcaagatactggcccgaggcttctgtgtcgacgacttcacattcctccgggacccctggaactggctggacttcagtgtcatcatgatggcgtacctgacagagtttgtggacttgggcaacatctcagccctgaggaccttccgggtgctgcgggccctcaaaaccatcacggtcatcccagggctgaagacgatcgtgggggccctgatccagtcggtgaagaagctgtcggatgtgatgatcctcactgtcttctgcctgagcgtctttgcgctggtaggactgcagctcttcatgggaaacctgaggcagaagtgtgtgcgctggcccccgccgttcaacgacaccaacaccacgtggtacagcaatgacacgtggtacggcaatgacacatggtatggcaatgagatgtggtacggcaatgactcatggtatgccaacgacacgtggaacagccatgcaagctgggccaccaacgatacctttgattgggacgcctacatcagtgatgaagggaacttctacttcctggagggctccaacgatgccctgctctgtgggaacagcagtgatgctgggcactgccctaagggttatgagtgcatcaagaccgggcggaaccccaactatggctacaccagctatgacaccttcagctgggccttcttggctctcttccgcctcatgacacaggactattgggagaacctcttccagctgacccttcgagcagctggcaagacctacatgatcttcttcgtggtcatcatcttcctgggctctttctacctcatcaatctgatcctggccgtggtggccatggcatatgccgagcagaatgaggccaccctggccgaggataaggagaaagaggaggagtttcagcagatgcttgagaagttcaaaaagcaccaggaggagctggagaaggccaaggccgcccaagctctggaaggtggggaggcagatggggacccagcccatggcaaagactgcaatggcagcctggacacatcgcaaggggagaagggagccccgaggcagagcggcagcggagacagcggcatctccgacgccatggaagaactggaagaggcccaccaaaagtgcccaccatggtggtacaagtgcgcccacaaagtgctcatatgggactgctgcgccccgtggctgaagttcaagaacatcatccacctgatcgtcatggacccgttcgtggacctgggcatcaccatctgcatcgtgctcaacaccctcttcatggccatggaacattaccccatgacggagcactttgacaacgtgctcactgtgggcaacctggtcttcacaggcatcttcacagcagagatggttctgaagctgattgccatggacccctacgagtatttccagcagggttggaatatcttcgacagcatcatcgtcaccctcagcctggtagagctaggcctggccaacgtacagggactgtctgtgctacgctccttccgtctgctgcgggtcttcaagctggccaagtcgtggccaacgctgaacatgctcatcaagatcattggcaattcagtgggggcgctgggtaacctgacgctggtgctggctatcatcgtgttcatcttcgccgtggtgggcatgcagctgtttggcaagagctacaaggagtgcgtgtgcaagattgccttggactgcaacctgccgcgctggcacatgcatgatttcttccactccttcctcatcgtcttccgcatcctgtgcggggagtggatcgagaccatgtgggactgcatggaggtggccggccaagccatgtgcctcaccgtcttcctcatggtcatggtcatcggcaatcttgtggtcctgaacctgttcctggctctgctgctgagctccttcagcgccgacagtctggcagcctcggatgaggatggcgagatgaacaacctgcagattgccatcgggcgcatcaagttgggcatcggctttgccaaggccttcctcctggggctgctgcatggcaagatcctgagccccaaggacatcatgctcagcctcggggaggctgacggggccggggaggctggagaggcgggggagactgcccccgaggatgagaagaaggagccgcccgaggaggacctgaagaaggacaatcacatcctgaaccacatgggcctggctgacggccccccatccagcctcgagctggaccaccttaacttcatcaacaacccctacctgaccatacaggtgcccatcgcctccgaggagtccgacctggagatgcccaccgaggaggaaaccgacactttctcagagcctgaggatagcaagaagccgccgcagcctctctatgatgggaactcgtccgtctgcagcacagctgactacaagccccccgaggaggaccctgaggagcaggcagaggagaaccccgagggggagcagcctgaggagtgcttcactgaggcctgcgtgcagcgctggccctgcctctacgtggacatctcccagggccgtgggaagaagtggtggactctgcgcagggcctgcttcaagattgtcgagcacaactggttcgagaccttcattgtcttcatgatcctgctcagcagtggggctctggccttcgaggacatctacattgagcagcggcgagtcattcgcaccatcctagaatatgccgacaaggtcttcacctacatcttcatcatggagatgctgctcaaatgggtggcctacggctttaaggtgtacttcaccaacgcctggtgctggctcgacttcctcatcgtggatgtctccatcatcagcttggtggccaactggctgggctactcggagctgggacccatcaaatccctgcggacactgcgggccctgcgtcccctgagggcactgtcccgattcgagggcatgagggtggtggtgaacgccctcctaggcgccatcccctccatcatgaatgtgctgcttgtctgcctcatcttctggctgatcttcagcatcatgggtgtcaacctgtttgccggcaagttctactactgcatcaacaccaccacctctgagaggttcgacatctccgaggtcaacaacaagtctgagtgcgagagcctcatgcacacaggccaggtccgctggctcaatgtcaaggtcaactacgacaacgtgggtctgggctacctctccctcctgcaggtggccaccttcaagggttggatggacatcatgtatgcagccgtggactcccgggagaaggaggagcagccgcagtacgaggtgaacctctacatgtacctctactttgtcatcttcatcatctttggctccttcttcaccctcaacctcttcattggcgtcatcattgacaacttcaaccagcagaagaagaagttaggggggaaagacatctttatgacggaggaacagaagaaatactataacgccatgaagaagcttggctccaagaagcctcagaagccaattccccggccccagaacaagatccagggcatggtgtatgacctcgtgacgaagcaggccttcgacatcaccatcatgatcctcatctgcctcaacatggtcaccatgatggtggagacagacgaccagagccagctcaaggtggacatcctgtacaacatcaacatgatcttcatcatcatcttcacaggggagtgcgtgctcaagatgctcgccctgcgccagtactacttcaccgttggctggaacatctttgacttcgtggtcgtcatcctgtccattgtgggccttgccctctctgacctgatccagaagtacttcgtgtcacccacgctgttccgtgtgatccgcctggcgcggattgggcgtgtcctgcggctgatccgcggggccaagggcatccggacgctgctgttcgccctcatgatgtcgctgcctgccctcttcaacatcggcctcctcctcttcctggtcatgttcatctactccatcttcggcatgtccaactttgcctacgtcaagaaggagtcgggcatcgatgatatgttcaacttcgagaccttcggcaacagcatcatctgcctgttcgagatcaccacgtcggccggctgggacgggctcctcaaccccatcctcaacagcgggcccccagactgtgaccccaacctggagaacccgggcaccagtgtcaagggtgactgcggcaacccctccatcggcatctgcttcttctgcagctatatcatcatctccttcctcatcgtggtcaacatgtacatcgccatcatcctggagaacttcaatgtggccacagaggagagcagcgagccccttggtgaagatgactttgagatgttctacgagacatgggagaagttcgaccccgacgccacccagttcatcgcctacagccgcctctcagacttcgtggacaccctgcaggaaccgctgaggattgccaagcccaacaagatcaagctcatcacactggacttgcccatggtgccaggggacaagatccactgcctggacatcctctttgccctgaccaaagaggtcctgggtgactctggggaaatggacgccctcaagcagaccatggaggagaagttcatggcagccaacccctccaaggtgtcctacgagcccatcaccaccaccctcaagaggaagcacgaggaggtgtgcgccatcaagatccagagggcctaccgccggcacctgctacagcgctccatgaagcaggcatcctacatgtaccgccacagccacgacggcagcggggatgacgcccctgagaaggaggggctgcttgccaacaccatgagcaagatgtatggccacgagaatgggaacagcagctcgccaagcccggaggagaagggcgaggcaggggacgccggacccactatggggctgatgcccatcagcccctcagacactgcctggcctcccgcccctcccccagggcagactgtgcgcccaggtgtcaaggagtctcttgtctagcaggcagcatcggggtggccccactgagtctcggcatagtccccagagctcccccgtggtgcctgcacacagagtgagggaggagggctttgaatctgggactgtgcctggctccctgatgggggacaggatttggccacactggggctgacacccaggcccgagcgcctgcgttcccagaccatgggaaatgggaattgcgctcaggggctccatgctgggtctgaggcccctgcctccaagatttaacctgcaagttgctctgacctcctctgggccctgtcgcccctccttttggcctgggggaggtcagaacattcgaatctctgcccctcacttgaggaggagctggcctgcggtggagggatcagttgccccccatcaccagagtcttaagggtcactggcctctccccaggaagtgggctcagacccccctcagccccagcccagacaaagatgtcttaacctcagggagtgcagacacctaaccccagggcactgccagcccaccccctttgactctggggtgcagcttcacccaccaggccagctcaggaattccctggaaaagggaaatgtgactggttcagaaatagctcctcaaagcctcaaaacctgattggccactggatcctgctgctttgggctgggatggtgactcctgaaacctcttcctaggccacgtccaggtccgtagctcccctggctggctcctaggggaagagcagaaggaaggatgccacttgggaatgaattgtccttttctaggaagcacgggggagtgagacaggctgggtcctgccagctggatcgctgcacatggcctgagcatccagacctgagcgggagtcagggacctgctgctcagtaagaagattctcgccccttccctctctccctgcctcactcctccgtgagcaccaccagggctccaggagcctcatccagcctcagagatctcccttctcatctccccacgccccgtctctttctcacctttcccacctctctccccaaagtgatcctaagaatgtacagttgagctcaggttagatatttcgaccctggggcgtgcagcagggaaggcccaactggttcaggctcaaccttccaacttcctgtggcctgaagaagcacttctgctgcatcgctgttctgggcatggcagggccaggcctctgctggctcaggaggaggggtgagagacctgctcaggcgtcgctggatttattcacttgtgtgtgtacctgtggctgtgtgtctgcttgtatgcttttataggcctgtgtgtatagctgtgtgtgtgttcaagtgcgtgactgtatgtgtgtgtgtgaaccactgtgtgaaccactgtgtactggagcctgcattatgcacgtgtctgggtatctttgtatatatgtgtatatatgtgtgccctggactgtttcaaggtccatggagtacggctggtgtgtcatactgtgcaggcctgtccctgggagtgttcccgtgcctgggagagtggacctgtgctgtgagtgtgtggatgcgtgtgaacgcatgtggtaaggtgtgtactcagggcattctgttggcctaagtgcctcttctttttcttcttgtttctcatgaaaagtttgattaaaattcaggaagcagcaaaaccttcaaaacaagacatgtatgtgtgcttgagtgtgtgaacacgtgtgtgtgtgtgcacatctacatgccatgcctatgggccagagttgtctttattgtccaccatgctctctcacctgcttcccagtcctgcctgaacagccctctctctcactcccctctcctccccttcctgtttctcgttgtcacacccatggcctcagccctgctccctgcctcctgcctatgtctcctctatggaaggaggcctccactccttccatctcttccttcagaagtttcgtctaatgggggcagtctccccttcctggcacattgcccctctgccttgccctcctgggccctgggctggcacagcccctggagcctcagaaatctgtttgattggatattctcctcggactgtgtgcaggttgcagaggaagagtagatgagccgggtccggcctctccctgcctgtggcccctcccctgcagacggatgcccattcctgcctggtccagtggggaacaggtcccacgccaggccagcaggcgggctcctttgtacagttcttacaataaaccctccttggtgcctctgg

SEQ ID NO: 85 - DNA, 2332 bp, Homo sapiens
gtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 86 - DNA, 2446 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 87 - DNA, 2579 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 88 - DNA, 2616 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 89 - DNA, 2749 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatccctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 90 - DNA, 2031 bp, Homo sapiens
ccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtg

SEQ ID NO: 91 - DNA, 2100 bp, Homo sapiens
ccggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtg

SEQ ID NO: 92 - DNA, 3311 bp, Homo sapiens
tgctaatgcttttggtacaaatggatgtggaatataattgaatattttcttgtttaaggggagcatgaagaggtgttgaggttatgtcaagcatctggcacagctgaaggcagatggaaatatttacaagtacgcaatttgagactaagatattgttatcattctcctattgaagacaagagcaatagtaaaacacatcaggtcagggggttaaagacctgtgataaaccacttccgataagttggaaacgtgtgtctatattttcatatctgtatatatataatggtaaagaaagacaccttcgtaacccgcattttccaaagagaggaatcacagggagatgtacagcaatggggccatttaagagttctgtgttcatcttgattcttcaccttctagaaggggccctgagtaattcactcattcagctgaacaacaatggctatgaaggcattgtcgttgcaatcgaccccaatgtgccagaagatgaaacactcattcaacaaataaaggacatggtgacccaggcatctctgtatctgtttgaagctacaggaaagcgattttatttcaaaaatgttgccattttgattcctgaaacatggaagacaaaggctgactatgtgagaccaaaacttgagacctacaaaaatgctgatgttctggttgctgagtctactcctccaggtaatgatgaaccctacactgagcagatgggcaactgtggagagaagggtgaaaggatccacctcactcctgatttcattgcaggaaaaaagttagctgaatatggaccacaaggtaaggcatttgtccatgagtgggctcatctacgatggggagtatttgacgagtacaataatgatgagaaattctacttatccaatggaagaatacaagcagtaagatgttcagcaggtattactggtacaaatgtagtaaagaagtgtcagggaggcagctgttacaccaaaagatgcacattcaataaagttacaggactctatgaaaaaggatgtgagtttgttctccaatcccgccagacggagaaggcttctataatgtttgcacaacatgttgattctatagttgaattctgtacagaacaaaaccacaacaaagaagctccaaacaagcaaaatcaaaaatgcaatctccgaagcacatgggaagtgatccgtgattctgaggactttaagaaaaccactcctatgacaacacagccaccaaatcccaccttctcattgctgcagattggacaaagaattgtgtgtttagtccttgacaaatctggaagcatggcgactggtaaccgcctcaatcgactgaatcaagcaggccagcttttcctgctgcagacagttgagctggggtcctgggttgggatggtgacatttgacagtgctgcccatgtacaaagtgaactcatacagataaacagtggcagtgacagggacacactcgccaaaagattacctgcagcagcttcaggagggacgtccatctgcagcgggcttcgatcggcatttactgtgattaggaagaaatatccaactgatggatctgaaattgtgctgctgacggatggggaagacaacactataagtgggtgctttaacgaggtcaaacaaagtggtgccatcatccacacagtcgctttggggccctctgcagctcaagaactagaggagctgtccaaaatgacaggaggtttacagacatatgcttcagatcaagttcagaacaatggcctcattgatgcttttggggccctttcatcaggaaatggagctgtctctcagcgctccatccagcttgagagtaagggattaaccctccagaacagccagtggatgaatggcacagtgatcgtggacagcaccgtgggaaaggacactttgtttcttatcacctggacaacgcagcctccccaaatccttctctgggatcccagtggacagaagcaaggtggctttgtagtggacaaaaacaccaaaatggcctacctccaaatcccaggcattgctaaggttggcacttggaaatacagtctgcaagcaagctcacaaaccttgaccctgactgtcacgtcccgtgcgtccaatgctaccctgcctccaattacagtgacttccaaaacgaacaaggacaccagcaaattccccagccctctggtagtttatgcaaatattcgccaaggagcctccccaattctcagggccagtgtcacagccctgattgaatcagtgaatggaaaaacagttaccttggaactactggataatggagcaggtgctgatgctactaaggatgacggtgtctactcaaggtatttcacaacttatgacacgaatggtagatacagtgtaaaagtgcgggctctgggaggagttaacgcagccagacggagagtgataccccagcagagtggagcactgtacatacctggctggattgagaatgatgaaatacaatggaatccaccaagacctgaaattaataaggatgatgttcaacacaagcaagtgtgtttcagcagaacatcctcgggaggctcatttgtggcttctgatgtcccaaatgctcccatacctgatctcttcccacctggccaaatcaccgacctgaaggcggaaattcacgggggcagtctcattaatctgacttggacagctcctggggatgattatgaccatggaacagctcacaagtatatcattcgaataagtacaagtattcttgatctcagagacaagttcaatgaatctcttcaagtgaatactactgctctcatcccaaaggaagccaactctgaggaagtctttttgtttaaaccagaaaacattacttttgaaaatggcacagatcttttcattgctattcaggctgttgataaggtcgatctgaaatcagaaatatccaacattgcacgagtatctttgtttattcctccacagactccgccagagacacctagtcctgatgaaacgtctgctccttgtcctaatattcatatcaacagcaccattcctggcattcacattttaaaaattatgtggaagtggataggagaactgcagctgtcaatagcctagggctgaatttttgtcagataaataaaataaatcattcatcctttttttgattataaaattttctaaaatgtattttagacttcctgtagggggcgatatactaaatgtatatagtacatttatactaaatgtattcctgtagggggcgatatactaaatgtattttagacttcctgtagggggcgataaaataaaatgctaaacaactgggtaaa

SEQ ID NO: 93 - DNA, 5541 bp, Homo sapiens
gtccagagtggcagtaaaggaggaagatggcggggtgcagggggtctctgtgctgctgctgcaggtggtgctgctgctgcggtgagcgtgagacccgcacccccgaggagctgaccatccttggagaaacacaggaggaggaggatgagattcttccaaggaaagactatgagagtttggattatgatcgctgtatcaatgacccttacctggaagttttggagaccatggataataagaaaggtcgaagatatgaggcggtgaagtggatggtggtgtttgccattggagtctgcactggcctggtgggtctctttgtggacttttttgtgcgactcttcacccaactcaagttcggagtggtacagacatcggtggaggagtgcagccagaaaggctgcctcgctctgtctctccttgaactcctgggttttaacctcacctttgtcttcctggcaagcctccttgttctcattgagccggtggcagcaggttccgggatacccgaggtcaaatgctatctgaatggcgtaaaggtgccaggaatcgtccgtctccggaccctgctctgcaaggtccttggagtgctgttcagtgtggctggagggctcttcgtggggaaggaaggccccatgatccacagtggttcggtggtgggagctggcctccctcagtttcagagcatctccttacggaagatccagtttaacttcccctatttccgaagcgacagagacaagagagactttgtatcagcaggagcggctgctggagttgctgcagctttcggggcgccaatcgggggtaccttgttcagtctagaggagggttcgtccttctggaaccaagggctcacgtggaaagtgctcttttgttccatgtctgccaccttcaccctcaacttcttccgttctgggattcagtttggaagctggggttccttccagctccctggattgctgaactttggcgagtttaagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcagagtcttagagagcctccttgtgtctctggtaaccaccgtggtggtgtttgtggcctcgatggtgttaggagaatgccgacagatgtcctcttcgagtcaaatcggtaatgactcattccagctccaggtcacagaagatgtgaattcaagtatcaagacatttttttgtcccaatgatacctacaatgacatggccacactcttcttcaacccgcaggagtctgccatcctccagctcttccaccaggatggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtggccaaatggacaggggactttttcaataagggcatttatgatatccacgtgggcctgcgaggcgtgccgcttctggaatgggagacagaggtggaaatggacaagctgagagccagcgacatcatggagcccaacctgacctacgtctacccgcacacccgcatccagtctctggtgagcatcctgcgcaccacggtccaccatgccttcccggtggtcacagagaaccgcggtaacgagaaggagttcatgaagggcaaccagctcatcagcaacaacatcaagttcaagaaatccagcatcctcacccgggctggcgagcagcgcaaacggagccagtccatgaagtcctacccatccagcgagctacggaacatgtgtgatgagcacatcgcctctgaggagccagccgagaaggaggacctcctgcagcagatgctggaaaggagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcgagcgccagccagccgcgcctctcctatgccgagatggccgaggactacccgcggtaccccgacatccacgacctggacctgacgctgctcaacccgcgcatgatcgtggatgtcaccccatacatgaacccttcgcctttcaccgtctcgcccaacacccacgtctcccaagtcttcaacctgttcagaacgatgggcctgcgccacctgcccgtggtgaacgctgtgggagagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagttacccactcactcagaaagccgggagtcatcggacaccttgctggtcagaggccctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcctaacacggtatcctcgctagtttgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatcagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccgcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtc

SEQ ID NO: 94 - DNA, 1774 bp, Homo sapiens
agatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcagaaactcttgaaagaaaaggactgtatatcttcaatctgacatcgctaaccaagtctgaaaacattttgtctgccacactgtatttctgtattggagagctaggaaacatcagcctgagttgtccagtgtctggaggatgctcccatcatgctcagaggaaacacattcagattgatctttctgcatggaccctcaaattcagcagaaaccaaagtcaactccttggccatctgtcagtggatatggccaaatctcatcgagatattatgtcctggctgtctaaagatatcactcaattcttgaggaaggccaaagaaaatgaagagttcctcataggatttaacattacgtccaagggacgccagctgccaaagaggaggttaccttttccagagccttatatcttggtatatgccaatgatgccgccatttctgagccagaaagtgtggtatcaagcttacagggacaccggaattttcccactggaactgttcccaaatgggatagccacatcagagctgccctttccattgagcggaggaagaagcgctctactggggtcttgctgcctctgcagaacaacgagcttcctggggcagaataccagtataaaaaggatgaggtgtgggaggagagaaagccttacaagacccttcaggctcaggcccctgaaaagagtaagaataaaaagaaacagagaaaggggcctcatcggaagagccagacgctccaatttgatgagcagaccctgaaaaaggcaaggagaaagcagtggattgaacctcggaattgcgccaggagatacctcaaggtagactttgcagatattggctggagtgaatggattatctcccccaagtcctttgatgcctattattgctctggagcatgccagttccccatgccaaagtctttgaagccatcaaatcatgctaccatccagagtatagtgagagctgtgggggtcgttcctgggattcctgagccttgctgtgtaccagaaaagatgtcctcactcagtattttattctttgatgaaaataagaatgtagtgcttaaagtataccctaacatgacagtagagtcttgcgcttgcagataacctggcaaagaactcatttgaatgcttaattcaat

SEQ ID NO: 95 - DNA, 7044 bp, Homo sapiens
tttttgtatttttagtagagacagggtttcaccatgttggtcaggctggtctcaaactcctgacttcgtgatctgcccaccttggcctcccaaagtgctgggattacaggcgtgagccaccgcacccggtcagctattttctacatgcttcatttgcagtgtaatattggattgtatgagactttgggttttgtgttaatacctacagaaaatgttgatattttctcttagcaggctgtcaaccaggttaggttcaggtcataagtttctacccacattctttgaactgtagttgtcattttagtttatttttcaaaaacttttgcagtacctttttggtctgtcttgtgtgtgccttgcagtgaacagtctggatttggacagtggtctgtctgttagttcagtttctcaagcctttgtcacactaataggattggatttatgtatgtccagcttgggaattattacaggaattaaaaacaactttttagagtgctttcctgagctctctttctatttgttcccccttctactttttgcttccctgtggctgctgtttctatcctccagccagagagctagtgtttattttctccattgtgttacacacttgtgcagctgcaaccaccatatccagggcccaatggtaggaggtagagaagaaaagcaaaagggattggcctcatcctcttacaacgatagttccattgaatagagagaaaggttttcctgcctcagagtgttggctgcactaggcttttgttactgtagtctggccctgttaccatgggattgcttgcatgtggggatacaggagaattcagaaaagaaaaaaagatttgctatttctacattctccctgagcattaagacttcccttgcccattcctcaattcaaagctaaggcttcttctggagctgcctctgtgggcggttcgggagataccaaaggagaaaaagtaccactgttgatatggtggtatttcaaattctggtctaccctatttcacatgccttgtttacttttcagagctgacagattgctgctccatgcattctgtccagtttcctaagagagacagcttggagtatgcttaatccatcttacctgggactgaaacagctgcttattttgccgttaaaaattacatgcagtttactgcgtggctccgggtttgtttgtttgtttttcctctttaataggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtaaaaaaaaaaa

SEQ ID NO: 96 - DNA, 5939 bp, Homo sapiens
gcggccgcgccctcgcacagatcccagctgggtcacccgcactgagtcaacagactgagcgcgtccaggcctgacagctctgcggctcgggccctgaggtttattcagaaaacatgtccactgcaattagggaggtaggagtttggagacagaccagaacacttctactgaagaattacttaattaaatgcagaaccaaaaagagtagtgttcaggaaattctttttccactattttttttattttggttaatattaattagcatgatgcatccaaataagaaatatgaagaagtgcctaatatagaactcaatcctatggacaagtttactctttctaatctaattcttggatatactccagtgactaatattacaagcagcatcatgcagaaagtgtctactgatcatctacctgatgtcataattactgaagaatatacaaatgaaaaagaaatgttaacatccagtctctctaagccgagcaactttgtaggtgtggttttcaaagactccatgtcctatgaacttcgtttttttcctgatatgattccagtatcttctatttatatggattcaagagctggctgttcaaaatcatgtgaggctgctcagtactggtcctcaggtttcacagttttacaagcatccatagatgctgccattatacagttgaagaccaatgtttctctttggaaggagctggagtcaactaaagctgttattatgggagaaactgctgttgtagaaatagatacctttccccgaggagtaattttaatatacctagttatagcattttcaccttttggatactttttggcaattcatatcgtagcagaaaaagaaaaaaaaataaaagaatttttaaagataatgggacttcatgatactgccttttggctttcctgggttcttctatatacaagtttaatttttcttatgtcccttcttatggcagtcattgcgacagcttctttgttatttcctcaaagtagcagcattgtgatatttctgctttttttcctttatggattatcatctgtattttttgctttaatgctgacacctctttttaaaaaatcaaaacatgtgggaatagttgaattttttgttactgtggcttttggatttattggccttatgataatcctcatagaaagttttcccaaatcgttagtgtggcttttcagtcctttctgtcactgtacttttgtgattggtattgcacaggtcatgcatttagaagattttaatgaaggtgcttcattttcaaatttgactgcaggcccatatcctctaattattacaattatcatgctcacacttaatagtatattctatgtcctcttggctgtctatcttgatcaagtcattccaggggaatttggcttacggagatcatctttatattttctgaagccttcatattggtcaaagagcaaaagaaattatgaggagttatcagagggcaatgttaatggaaatattagttttagtgaaattattgagccagtttcttcagaatttgtaggaaaagaagccataagaattagtggtattcagaagacatacagaaagaagggtgaaaatgtggaggctttgagaaatttgtcatttgacatatatgagggtcagattactgccttacttggccacagtggaacaggaaagagtacattgatgaatattctttgtggactctgcccaccttctgatgggtttgcatctatatatggacacagagtctcagaaatagatgaaatgtttgaagcaagaaaaatgattggcatttgtccacagttagatatacactttgatgttttgacagtagaagaaaatttatcaattttggcttcaatcaaagggataccagccaacaatataatacaagaagtgcagaaggttttactagatttagacatgcagactatcaaagataaccaagctaaaaaattaagtggtggtcaaaaaagaaagctgtcattaggaattgctgttcttgggaacccaaagatactgctgctagatgaaccaacagctggaatggacccctgttctcgacatattgtatggaatcttttaaaatacagaaaagccaatcgggtgacagtgttcagtactcatttcatggatgaagctgacattcttgcagataggaaagctgtgatatcacaaggaatgctgaaatgtgttggttcttcaatgttcctcaaaagtaaatgggggatcggctaccgcctgagcatgtacatagacaaatattgtgccacagaatctctttcttcactggttaaacaacatatacctggagctactttattacaacagaatgaccaacaacttgtgtatagcttgcctttcaaggacatggacaaattttcaggtttgttttctgccctagacagtcattcaaatttgggtgtcatttcttatggtgtttccatgacgactttggaagacgtatttttaaagctagaagttgaagcagaaattgaccaagcagattatagtgtatttactcagcagccactggaggaagaaatggattcaaaatcttttgatgaaatggaacagagcttacttattctttctgaaaccaaggctgctctagtgagcaccatgagcctttggaaacaacagatgtatacaatagcaaagtttcatttctttaccttgaaacgtgaaagtaaatcagtgagatcagtgttgcttctgcttttaatttttttcacagttcagatttttatgtttttggttcatcactcttttaaaaatgctgtggttcccatcaaacttgttccagacttatattttctaaaacctggagacaaaccacataaatacaaaacaagtctgcttcttcaaaattctgctgactcagatatcagtgatcttattagctttttcacaagccagaacataatggtgacgatgattaatgacagtgactatgtatccgtggctccccatagtgcggctttaaatgtgatgcattcagaaaaggactatgtttttgcagctgttttcaacagtactatggtttattctttacctatattagtgaatatcattagtaactactatctttatcatttaaatgtgactgaaaccatccagatctggagtaccccattctttcaagaaattactgatatagtttttaaaattgagctgtattttcaagcagctttgcttggaatcattgttactgcaatgccaccttactttgccatggaaaatgcagagaatcataagatcaaagcttatactcaacttaaactttcaggtcttttgccatctgcatattggattggacaagctgttgttgatatccccttattttttatcattcttattttgatgctaggaagcttattggcatttcattatggattatatttttatactgtaaagttccttgctgtggttttttgccttattggttatgttccatcagttattctgttcacttatattgcttctttcacctttaagaaaattttaaataccaaagaattttggtcatttatctattctgtggcagcgttggcttgtattgcaatcactgaaataactttctttatgggatacacaattgcaactattcttcattatgccttttgtatcatcattccaatctatccacttctaggttgcctgatttctttcataaagatttcttggaagaatgtacgaaaaaatgtggacacctataatccatgggataggctttcagtagctgttatatcgccttacctgcagtgtgtactgtggattttcctcttacaatactatgagaaaaaatatggaggcagatcaataagaaaagatccctttttcagaaacctttcaacgaagtctaaaaataggaagcttccagaaccaccagacaatgaggatgaagatgaagatgtcaaagctgaaagactaaaggtcaaagagctgatgggttgccagtgttgtgaggagaaaccatccattatggtcagcaatttgcataaagaatatgatgacaagaaagattttcttctttcaagaaaagtaaagaaagtggcaactaaatacatctctttctgtgtgaaaaaaggagagatcttaggactattgggtccaaatggtgctggcaaaagcacaattattaatattctggttggtgatattgaaccaacttcaggccaggtatttttaggagattattcttcagagacaagtgaagatgatgattcactgaagtgtatgggttactgtcctcagataaaccctttgtggccagatactacattgcaggaacattttgaaatttatggagctgtcaaaggaatgagtgcaagtgacatgaaagaagtcataagtcgaataacacatgcacttgatttaaaagaacatcttcagaagactgtaaagaaactacctgcaggaatcaaacgaaagttgtgttttgctctaagtatgctagggaatcctcagattactttgctagatgaaccatctacaggtatggatcccaaagccaaacagcacatgtggcgagcaattcgaactgcatttaaaaacagaaagcgggctgctattctgaccactcactatatggaggaggcagaggctgtctgtgatcgagtagctatcatggtgtctgggcagttaagatgtatcggaacagtacaacatctaaagagtaaatttggaaaaggctactttttggaaattaaattgaaggactggatagaaaacctagaagtagaccgccttcaaagagaaattcagtatattttcccaaatgcaagccgtcaggaaagtttttcttctattttggcttataaaattcctaaggaagatgttcagtccctttcacaatctttttttaagctggaagaagctaaacatgcttttgccattgaagaatatagcttttctcaagcaacattggaacaggtttttgtagaactcactaaagaacaagaggaggaagataatagttgtggaactttaaacagcacactttggtgggaacgaacacaagaagatagagtagtattttgaatttgtattgttcggtctgcttactgggacttctttctttttcacttaattttaactttggtttaaaaagttttttattggaatggtaactggagaaccaagaacgcacttgaaatttttctaagctccttaattgaaatgctgtggttgtgtgttttgcttttctttaaataaaacgtatgtataattaagtgaagctgcatgtttgtattgaagtatattgaactatatagtttgtatgtcatctttttcaccattcagaaacagtgcttctgaatttgtgatttaaaggaattgtaatagaatagttttatttttaagttatctttaagtttatgccatcttcttaaataagtacgtaatgttccaatctaaataaaaaactaattcataactaatgcatagaaaagatacataaagcaatgtgaaagtttcttgcttctcctttttaatttctaaaaaagccactttgaatggaagttgtcatccgtaaaagctgaagtgtaagcactaggaaatctcaatatagagatttgaggaaagttatatccactaggtggcagtcattgatcataataagtgaaatgagcccttgttctagtacatgattttaggcttaggtaattaggtatgtgaaattacatttctttaatttaaagtaaaattcagaaggttttagttattataattaaaggaagactgtgtgtagaatcttacgtaatagtctgattctttgactctgtggctagaatgacagttatctatggaggtggtagaattaagccataccttttccttcatcactcttggaacatataaattttttgtcatcttccttgcaaagggcacatttaattttgttcttgaataaaatattttattgggtaaaaaaaaaaa

SEQ ID NO: 97 - DNA, 1575 bp, Homo sapiens
atggagaacaaagaggcgggaacccctccacccattccatccagggaggggcggctccagccgacgctgttgctggcgacactgagcgcggcctttggctcagccttccagtacggctacaacctctctgtggtcaacacgccgcacaaggtgggcacaagctgtggatggggcaatgttttccaggtcttcaagtcattttacaacgaaacctactttgagcgacacgcaacattcatggacgggaagctcatgctgcttctatggtcttgcaccgtctccatgtttcctctgggcggcctgttggggtcattgctcgtgggcctgctggttgatagctgcggcagaaaggggaccctgctgatcaacaacatctttgccatcatccccgccatcctgatgggagtcagcaaagtggccaaggcttttgagctgatcgtcttttcccgagtggtgctgggagtctgtgcaggcatctcctacagcgcccttcccatgtacctgggagaactggcccccaagaacctgagaggcatggtgggaacaatgaccgaggttttcgtcatcgttggagtcttcctagcacagatcttcagcctccaggccatcttgggcaacccggcaggctggccggtgcttctggcgctcacaggggtgcccgccctgctgcagctgctgaccctgcccttcttccccgaaagcccccgctactccctgattcagaaaggagatgaagccacagcgcgacaagctctgaggaggctgagaggccacacggacatggaggccgagctggaggacatgcgtgcggaggcccgggccgagcgcgccgagggccacctgtctgtgctgcacctctgtgccctgcggtccctgcgctggcagctcctctccatcatcgtgctcatggccggccagcagctgtcgggcatcaatgcgatcaactactatgcggacaccatctacacatctgcgggcgtggaggccgctcactcccaatatgtaacggtgggctctggcgtcgtcaacatagtgatgaccatcacctcggctgtccttgtggagcggctgggacggcggcacctcctgctggccggctacggcatctgcggctctgcctgcctggtgctgacggtggtgctcctattccagaacagggtccccgagctgtcctacctcggcatcatctgtgtctttgcctacatcgcgggacattccattgggcccagtcctgtcccctcggtggtgaggaccgagatcttcctgcagtcctcccggcgggcagctttcatggtggacggggcagtgcactggctcaccaacttcatcataggcttcctgttcccatccatccaggaggccatcggtgcctacagtttcatcatctttgccggaatctgcctcctcactgcgatttacatctacgtggttattccggagaccaagggcaaaacatttgtggagataaaccgcatttttgccaagagaaacagggtgaagcttccagaggagaaagaagaaaccattgatgctgggcctcccacagcctctcctgccaaggaaacttccttttag

SEQ ID NO: 98 - DNA, 2796 bp, Homo sapiens
gcggggctggcacccgggccgaggctctgattctggggggaggccgactccaccctggctggaggaactgggtgctcctgcccgctggcccctcgcgcgtgaggatctatctcaggctaagaaatggcatttcaaaaggcagtgaaagggacgattcttgttggaggaggtgctcttgcaactgttttaggactttctcagtttgctcattacagaaggaaacaaatgaacctggcctatgttaaagcagcagactgcatttcagaaccagttaacagggagcctccttccagagaagctcagctactgactttgcaaaacacatctgaatttgatatccttgttattggaggaggagcaacaggaagtggctgtgcgctagatgctgtcaccagaggactaaaaacagcccttgtagaaagagatgatttctcatcagggaccagcagcagaagcactaaattgatccatggtggtgtgagatatctgcagaaggccatcatgaagttggatattgagcagtataggatggtaaaagaagcccttcatgagcgtgccaacctgctagaaattgctccccatttatcagctccattgcctataatgcttccagtttacaagtggtggcagttaccttactactgggtaggaatcaagctgtatgatttggttgcaggaagcaattgcctaaaaagcagttatgtcctcagcaaatcaagagcccttgaacatttcccaatgctccagaaggacaaactggtaggagcaattgtctactatgacggacaacataacgatgcacggatgaaccttgccattgctctgactgctgccaggtatggggctgccacagccaattacatggaggtagtgagcttgctcaagaagacagacccccagacagggaaagtgcatgtgagcggcgcacggtgcaaggatgtcctcacagggcaggaatttgacgtgagagccaaatgtgttatcaatgccacgggacctttcacggactctgtgcgcaaaatggatgataaagacgcagcagctatctgccagccaagtgctggtgtccatattgtgatgcctggttattacagcccagagagcatgggacttcttgacccagcgaccagtgatgggcgagttattttcttcttaccctggcaaaagatgacgatcgctggcactactgatactccaactgatgttacacaccatccaattccttcagaagaagatatcaacttcattttgaatgaagtgcgtaattacctgagttgtgatgttgaagtgagaagaggggatgtcctggcagcatggagtggaatccgtcctcttgttacagaccccaaatctgcagatactcagtctatctcccgaaatcatgttgttgatatcagtgagagtggccttattactatagcaggtggaaagtggacaacttatcggtctatggcagaagataccataaatgctgctgtcaaaactcataatttaaaagcaggaccaagtagaacagttgggcttttccttcaagggggtaaagattggagccccacactctacattaggcttgtgcaggattatggacttgaaagcgaggtggcacagcatcttgccgccacctatggtgataaggcctttgaggtggccaaaatggcaagtgtgactggcaaaaggtggcctattgttggagtacatcttgtgtcagaatttccatatattgaagcagaggtgaaatatgggattaaggagtatgcctgcactgctgtggatatgatttcacgtcgtactcgcctggcctttctaaatgtccaggcagcagaggaagccctacccaggattgttgaactgatgggcagggaactgaattgggatgattataagaagcaggaacaacttgaaacagccaggaagtttctatattatgaaatgggctataaatctcgatcagaacagttaacagatcgctctgaaattagcctactgccttcagacattgacaggtataagaagagatttcataagtttgatgcagaccagaaaggctttattaccattgttgatgttcagcgtgtattagagagtatcaatgtccaaatggatgaaaatacactccatgaaattctaaatgaagttgatttgaataaaaatggacaggttgaactcaatgaatttttgcagctgatgagtgctattcaaaaaggaagggtatctggaagccggcttgctatactaatgaaaactgcagaagagaacctcgacagaagagttccaattccagtggaccgtagttgtggaggattgtgagtctgggcagtaaatccacagccaacaaacatagaaacgacaaatcaccatgtaacaaccagagatgactgaaaccactctgaaataatgaatgtggatagctgccttttttaacactagaaaacattccaaaactttaaggtgttggtgtatttgccagctttatttgctgtactttatttgtatttgccattcagtctagcttttaagtatatttttttctttttctcattttcaatgcacattagttttgcatctgttttgtgacctgttagatgtgacacattctctttttgtttattcccttattctaaatgagttctaaaaacataatattttggcaaaaattgaaaaaagctggagacattttgtgacatgcatacagatagcatgtgttattaaaaagagttgcctattgaaatgatcgtgtttctggagaaattaagcttatagacagcatgtgttattaaaaagagttacctattgaaa

SEQ ID NO: 99 - DNA, 3580 bp, Homo sapiens
ggaaaggaaaccggcactgcctgccggctttacatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgacacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaaagctctatgaaagaatataggaagtttctccttttcacaccttatttcattgactgctggctgctttaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaaaa

SEQ ID NO: 100 - DNA, 2468 bp, Homo sapiens
attaaaggctagtctcaggctggggatggctcctgtctatttcttctctctcagagactgcagatggcttttccctgccgcaggtccctgactgccaagactctggcctgcctcctggtgggcgtgagtttcttagcactgcagcagtggttcctccaggcgccaaggtccccgcgggaggagaggtccccgcaggaggagacgccagagggtcccaccgacgctcccgcggctgacgagccgccctcggagctcgtccccgggcccccgtgcgtggcgaacgcctcggcgaacgccacggccgacttcgagcagctgcccgcgcgcatccaggacttcctgcggtaccgccactgccgccacttcccgctgctttgggacgcaccggccaagtgcgccggcggccgaggcgtgttcctgctcctggcggtgaagtcggcgcctgagcactacgagcgacgcgagctcatccggcgcacgtgggggcaagagcgcagctacggcgggcggccagtgcgccgcctctttctattgggcaccccgggccccgagaacgaggcgcgcgcggagcggctggcggagctggtggcgctggaggcgcgcgagcacggcgacgtgctgcagtgggccttcgcggacaccttcctcaacctcacgctcaagcacctgcacttgctcgactggctggctgcacgctgcccgcacgcgcgctttctgctcagcggcgacgacgacgtgttcgtgcacaccgccaacgtagtccgcttcctgcaggcgcagccacccggccgccacctgttctccggccagctcatggagggctccgtgcccatccgcgacagctggagcaagtacttcgtgccgccgcagctcttccccgggtccgcttacccggtgtactgcagcggcggcggcttcctcctgtccggccccacggcccgggccctgcgcgcggccgcccgccacaccccgctcttccccatcgacgacgcctacatgggcatgtgtctggagcgcgccggcctggcgcccagcggccacgagggcatccggcccttcggcgtgcagctgcctggcgcacagcagtcctccttcgacccctgcatgtaccgcgagttgctgctagtgcaccgcttcgcgccctacgagatgctgctcatgtggaaggcgctgcacagccccgcgctcagctgtgaccggggacaccgggtctcctgaggccagttgggcggcttcagccccgggcctccaaccatgtccatgctgagaaggcagctttcccgctctgggtaccttacgtcctgcccagctctgtgcacctgaaccccagctgcgcactgaaatcagctggggtggggggtgtggaaaatgcctacatcctggctccatctcccgaagtttcgatttgattagtctggggtggacccagacatgttaagtattttttaagttcctccagtgatgcgaatgtgcagctaggcctgaggaccactcggctagactatctcttcatcctcgcaaagccagctccaccgccctctctgcaagaattccgggcccctcgctcccacactcgggtcctcttgagcagtggagcaagggagacctgggagcgtgggagccaggatcagcgccccctgccatgtgcctacaaatgtcagttgtgacttccactgtttacaagtgagtggagctggagctgggctgacagtatcaggtggatcccgcttccccctcccccaagaagtcagccaacacgcagctgaggcgcatgtggtggccttcttcccaccactaccccagtacaccgtgaggtagaaatcttcaccgtgcaaagtggaaaccagaggcccggtcagacagtgactaatccagggccgtggcattcccagacagcacaccactgtggtcccctccacactcaccccaaccaaagctaatggcctagttgggtcctgcccgccaataatcacccccacgggtcagagacaggctccttgccggggtctgggcctcaggctcagtgggccttggacaacccagcagggagttccggggagtccgaagtggagaaaggctggtgggaacatggaggccagtgttggggagcctgtggaggcaggtgtgtagaattgtgttcgggaggtgggggatctgagaccgaagtggacagtggttaagattgtggggccgggcgaggtggctcacgcctgtaatcccagcactttgggaggctgaggaggtcggatcatgaggtcaagagttcgagaccagcctggccaatatggtgaaaccccgtctctattgggagtacaaaaattagccggccatagtggctcgtgcctgtaatctcagctatttgggaggctgaggcaggagaatcacttgaacctgggaggcggaggttgcagtgagccgagatcgtgccactgcactccagcctgggcgacagagcaagactgcatctc

SEQ ID NO: 101 - DNA, 980 bp, Homo sapiens
cagccagtgcaactcagccggctgcctcttcgacggctttgactgccagcgtgcggaaggccagtgcaaccccctgtacgaccagtactgcaaggaccacttcagcgacgggcactgcgaccagggctgcaacagcgcggagtgcgagtgggacgggctggactgtgcggagcatgtacccgagaggctggcggccggcacgctggtggtggtggtgctgatgccgccggagcagctgcgcaacagctccttccacttcctgcgggagctcagccgcgtgctgcacaccaacgtggtcttcaagcgtgacgcacacggccagcagatgatcttcccctactacggccgcgaggaggagctgcgcaagcaccccatcaagcgtgccgccgagggctgggccgcacctgacgccctgctgggccaggtgaaggcctcgctgctccctggtggcagcgagggtgggcggcggcggagggagctggaccccatggacgtccgcggctccatcgtctacctggagattgacaaccggcagtgtgtgcaggcctcctcgcagtgcttccagagtgccaccgacgtggccgcattcctgggagcgctcgcctcgctgggcagcctcaacatcccctacaagatcgaggccgtgcagactcagtgcgagtgcagcgatttgaagttgactaatcctccttccttaaaggagaaaaaagtaaaagccgtctccagatagagtcggctggtgcaggagagaatttagcgatagtttgcaattctgattaatcgcgtagaaaatgaccttattttggagggcgggatggaggagagtgggtgaggaggcgcccggacgcggagccagtccgccgccccccggccaccagcctgctgcgtagccgctgcctgatgtccgggcacctgcccctggcccccgtgcccgcaggtgagaccgtggagccgcccccgccggcgcagctgcacttcat

SEQ ID NO: 102 - DNA, 354 bp, Homo sapiens
atgggagacgacaacgacactgcccagaaccccgacatcactgtggacggtacgcccttgggctgcatctccttcaagctaattattccagagtttatgtgtcagggtagtgacttcacacaccataatggcactggtggcaagtccatctatagggagaaatttgatgataagaacttcactctgaagcatacaagtcccggcatcttgtccatgtcaaatgctggacccaacacaaatggttcccagtttttcatctgcactgccaagacctcagtggccatggagtgctctagatccagaaacggcaagaccagtgagaagatcaccattgccgactgtggacaattctaa

SEQ ID NO: 103 - DNA, 2513 bp, Homo sapiens
gggtgtgatgcgagcgtcacggtggggatgctgctggctgcgcggcgctgagggccagcgagagcgagagcccgcccggggcggaggacggactcatccggatctggctgcagcgtgggctcggagctcccccttcctctcggtctccctctcggcccccctttatttccttcttgctttgcgtctttaacacctctcgaccctgtcctccccccgccactggaagtcttcccgtctctaaatggaattagtggagcccggagcctctggtgtaacgcacagacatgatccatgggcgcagcgtgcttcacattgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacaactactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctg

SEQ ID NO: 104 - DNA, 2328 bp, Homo sapiens
acagccacactgcagtatgtcaggaacagtcatggagctgttctcattgtttgcctctccttttcctcctttttaccttctggcccctctcttcattcagagatgctggcagagccattccctaaggttgtagcaagtttaatcatcctccatttgtctggggcaaccaagaaaggaacagaaaagcaaaccacctcagaaacacagaagtcagtgcagtgtggaacttggacaaaacatgcagagggaggtatctttacctctcccaactatcccagcaagtatccccctgaccgggaatgcatctacatcatagaagccgctccaagacagtgcattgaactttactttgatgaaaagtactctattgaaccgtcttgggagtgcaaatttgatcatattgaagttcgagatggaccttttggcttttctccaataattggacgtttctgtggacaacaaaatccacctgtcataaaatccagtggaagatttctatggattaaattttttgctgatggagagctggaatctatgggattttcagctcgatacaatttcacacctgatcctgactttaaggaccttggagctttgaaaccattaccagcgtgtgagtttgagatgggcggttccgaaggaattgtggagtctatacaaattatgaaggaaggcaaagctactgctagcgaggctgttgattgcaagtggtacatccgagcacctccacggtccaagatttacttacgattcttggactatgagatgcagaattcaaatgagtgcaagaggaattttgtggctgtgtatgatggaagcagttccgtggaggatttgaaagctaagttctgtagcactgtggctaatgatgtcatgctacgcacgggtcttggggtgatccgcatgtgggcagatgagggcagtcgaaacagccgatttcagatgctcttcacatcctttcaagaacctccttgtgaaggcaacacattcttctgccatagtaacatgtgtattaataatactttggtctgcaatggactccagaactgtgtgtatccttgggatgaaaatcactgtaaagagaagaggaaaaccagcctgctggaccagctgaccaacaccagtgggactgtcattggcgtgacttcctgcatcgtgatcatcctcattatcatctctgtcatcgtacagatcaaacagcctcgtaaaaagtatgtccaaaggaaatcagactttgaccagacagttttccaggaggtatttgaacctcctcattatgagttatgcactctcagagggacaggagctacagctgactttgcagatgtggcagatgactttgaaaattaccataaactgcggaggtcatcttccaaatgcattcatgaccatcactgtggatcacagctgtccagcactaaaggcagccgcagtaacctcagcacaagagatgcttctatcttgacagagatgcccacacagccaggaaaacccctcatcccacccatgaacagaagaaatatccttgtcatgaaacacaactactcgcaagatgctgcagatgcctgtgacatagatgaaatcgaagaggtgccgaccaccagtcacaggctgtccagacacgataaagccgtccagcggttctgcctcattgggtctctaagcaaacatgaatctgaatacaacacaactagggtctagaaagaaaattcaagagaagaactatttatacaaacatggggactgtgaaaagaaaattctatagtgaattgtgaaaagtggacatatttctaaattcattccactgcctttatccaaacttaagaattacagacatttgttattccttcggcaagacatccccgctgcacactgatatgttcatttcgtaatttggttgctggccaccaagtgctccttagtttttaaatacattttgagattaactggaaacttgaagaagaaattagttcccgattaagactatcccaactttatttttattgtcagtttcacttttgtttctatgttgttttatgtctttgttatataattgtacattgtgtgatatgtgaaaaaaaaacacgaatttggatgaaccttgtgttacatgtacattgttttcattatatagacagcttgagaatagtgcgttcctgaatgattttgaacatgctacagtgaaaagtgacagtgtggaccatggaatcaccagctagaggttatggactatacacacctattattatattctgattaaatacaggaaaaagtaacaagtaaaattactagattgcaataaaaaaattcattttttggtctttcctg

SEQ ID NO: 105 - DNA, 3401 bp, Homo sapiens
gggtacgagccccgcccgagctcaccgcccctgctcccctctccgaccctttgagccgtggccgttgccagatgtccacaatgggaaacgaggccagttacccggcggagatgtgctcccactttgacaatgatgaaattaaaaggctgggcaggaggtttaagaagttggacttggacaaatcagggtctctgagcgtggaggagttcatgtccctgccggagctgcgccacaacccgttggtgcggcgagtgatcgacgtcttcgacaccgacggtgatggagaagtggacttcaaggaattcatcctggggacctcccagttcagcgtcaagggcgacgaggagcagaagttgaggtttgcgttcagcatttacgacatggataaagatggctacatttccaacggggagctcttccaggtgctgaagatgatggtgggcaacaacctgacggactggcagctccagcagctggtcgacaaaaccatcatcatcctggacaaggatggcgatgggaagatatcctttgaggaattcagtgctgtggtcagagacctggagatccacaagaagctggtcctcatcgtatgagcctttttcttacaagcaccacccaacaacttctgctttcttccctatctctttcaagatttgctcaagacgtccaactgtctctctgacttatctggaagtatttctttttgtgaagccatatgtcctaacaggagcttcatcaccaactcagtgctattaattctccttctctgaatgactcagggtaccctatagggggaagagcaagtcaaatgagcatagtggggaaagaaaaggaaatggcttttataaacatcttttactttgttttgattcaaagaccaaactagaactttaaaagttcaaaaataagaaagtatacatttttgctgttatttctcatcattttgtatatgggaggaaatttataatttgcatgggtgttaggtgaactgttttcatttgcttgtgttcagatatcttgccagattgttaacttcctattgtagcaacagggacaaatatatttgtctttgctgggcatctcgtaatcacttttcttaggggacagaatcccatcttttccttcggcagattgcagccccattccccacaatgcatccagaaatcgctgtgcatgtttgaggggtaggagttcatttggcctcctcctgacttgttgctccagctcctgaacagaaactagcttcagggctcttataggaaatgctaagcctggactaagtgcccagctcagccatcatcctcattagcagtgggtttccagggttggcagcccacaccagcattaatttcaatgaaggggacctccagctaaatagggcaagcaaagtgttctcccagaaagtgctctcacctccgacactggtccctacccccaggtggagacaatgagacatttagttagttgtcctacggaggagaggcagtagagtcaggctgcagtggaatctccctaggatgccaaagtggcattatgtctgttgctcacagatgcagagactgacaattgtgtctccacagcagaggtggatgctagctacaccagctatgctgattttgaaaatcagatctgaggcctagaagagaaactgagagctctctcattccaggaagccttttccctagtggaacattcagtgcagaagtcctcacacactaacagatctccaccattgggtgagccggagcctgtggttccaggggagatccagaatgcatgtgtctcttcccacgcatttatgtcatgttggtagctttagatcagccatggtgagaaaagaacaaaagcttttagttgtttttgttttgttttggagaatttgtttaccagtaaatacatcactgcctgtaccccaaatgttaccagctccctgaggtgtcccacatactattgtgagttctcagagcatgaactgtcctcagaagagcagggctaggacttgtcccagcatctgtgcctccataccaatcctctttctcacagagaaccacttcccatataagatgcttaaggctctcaaaacagcagaacaatgaaacatactctccctacacttgcttagccaagagataccactcaggtaacttttttcaggacatggaagatctgtttcaaggagatttactgctattttatttggaagaagctggcaactggtcttgaccaaaatagaaaaaaaaaaaaaaagtccacaaatttaatcacttgtagggaacccatctatcaaggtaccctaccatatacttttgtatttaatagattacttagaaaccacaaaaataggaatccttaccccttcaattcctgttcaaccctaaaaactgtgataaacgctcccaaccctgtggtgatcagggttatgtaatgttcaaagattcagacacacctgggtttggattcagttgcaactgggttgttatcacactcacttctttttagctgtgtgagcatgaataatttacttagcctctctgtgtctttccacctaattaaagaggatccaccccagggttattttgaggattcaaaaaggcatgcaacacacctggagcacaattccactttcattcaactaattcccttcccttcccccttcttccccttctacaagatcaatatgtaaaggagacatgaggcttactggttgcttttgaacacttacttagttcttagctacacccactctaaaattaactggacattagtgtacagcccatgtccaagcccagagagaaaacaatgggaacaatttcaaggtcctcaccactccttcatttgcagaggggacaacagactttctgaccagagaactggagaatttttaaaacaaaatctctcattccagcccaacctatttaactttttgtggaggaattttacatggaggaagtgagcacatgtcatgctagccaagaggacattattgtcattaaagagaggcattatttatacaccctgcaatgtgcacattaaaatatggaaattttaaaattatgaccaagggcttgaaacatattggattacatgctcacatttaacaaagagaggaaatgtgtttcagtttctggagtggctggaatttacaagctaattgttcaataaatctactcaagatagttacctaaggctttgtggcaatgaccttgaactgagagcctgtatctggatttagcacttgaaagatctaactggatatttgggttaaaagaatcacatttattcccaaatcggaatgctttgtttttcctgtcagttaattgccagttgccaacaaatctagttctatacagtttcttgggatgatgataataaacatttattgagcaaaaaaaaaaaaaaaa

SEQ ID NO: 106 - DNA, 4148 bp, Homo sapiens
gtctgtccccatctctcaatctcatgctgagtctctctgtctccaactgcctgtcactgtctttgtgtctctgtgactctcatttctttttttctgtctcctgctgtctctgtgtgggattccttgtctctctgcccctgccctccctctcctatctgaaccctggtctctgtgtcccttagggcttatcacaccgttctccccagagtcaccgggaggagagccgggactggacacaagccagggctgggacaatggcagtgcctagtctgtggccctggggagcatgcctgcctgtgatcttcctctccttgggatttggcctggatacagtagaggtgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatatgtatgtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 107 - DNA, 3808 bp, Homo sapiens
tgtgccccagcctggatattcgctcagaggtggcagagcttcgtcagctggagaactgcagcgtggtggagggccacctgcagatcctgctcatgttcacagccaccggggaggacttccgcggcctcagcttccctcgcctcacccaggtcaccgactacctgctgctcttccgtgtctacggactggagagcctgcgcgacctcttccccaacctagcagtcatccgcgggacgcgcctcttcctgggctatgcactggtcatctttgagatgccacatctgcgtgacgtggcactgcctgcacttggggccgtgctgcgtggggctgtgcgtgtggagaagaaccaggagctctgccacctctccaccattgactggggactgctgcagccagcacctggcgccaaccacatcgtgggcaacaagctgggcgaggagtgtgctgacgtgtgccctggtgtgctgggtgctgctggtgagccctgtgccaagaccaccttcagcgggcacactgactacagatgctggacctccagccactgccagagagtgtgcccctgcccccatgggatggcttgcacagcgaggggcgagtgctgccacaccgaatgcctggggggctgcagccagccagaagaccctcgtgcctgtgtagcttgccgccacctctacttccagggtgcctgcctgtgggcctgcccgccaggcacctaccagtatgagtcctggcgctgtgtcacagctgagcgctgtgccagcctgcactctgtgcccggccgtgcctccaccttcggcatacaccagggcagttgcctggcccagtgcccttctggcttcacccgtaatagcagcagcatattctgccacaagtgcgaggggctgtgccctaaagagtgcaaggtaggcaccaagaccatcgactccatccaggcggcacaggatcttgtgggctgcacgcatgtggagggaagcctcatcctcaaccttcgccagggctacaacctggagccacagctgcagcacagcctggggctggtagaaaccattactggcttcctcaaaatcaagcactcctttgccctcgtgtccctgggctttttcaagaacctcaaactaatccggggagacgccatggtggatgggaactacactctctacgtgctggacaaccagaacctacaacagctagggtcctgggtggccgcggggctcaccattcccgtgggcaagatctacttcgccttcaacccgcgcctctgcttggaacacatctaccgactggaggaggtgacaggcacgcgaggtcggcagaacaaggctgagatcaacccccgcaccaacggagaccgcgccgcctgccagactcgcaccctgcgcttcgtgtccaacgtgacggaggcagaccgcatcctgctacgctgggagcgctatgagccactggaggcccgcgacctgctcagcttcatcgtgtactacaaggagtccccattccagaacgccacagagcacgtgggtccagatgcttgtggaacccagagctggaacctgctggatgtggagctgcccctaagccgcacccaggagccaggggtgaccctagcctccctcaagccttggacacagtacgcagtgtttgtgcgggccatcacgctaaccactgaggaggacagccctcatcaaggagcccagagtcccatcgtctacctccgaacgctgcctgcagctcccacggtgccccaagacgtcatctccacgtccaactcctcctcccacctcctggtgcgctggaagccaccgacccagcgcaatgggaacctcacctactacctggtgctgtggcagcggctggcagaggacggcgacctctacctcaatgactactgccaccgcggcttgcggctgcccaccagcaacaacgatccgcgcttcgacggcgaagacggggatcctgaggccgagatggagtccgactgctgcccttgccagcacccacctcctggtcaggttctgcccccgctggaggcgcaagaggcctcgttccagaagaagtttgaaaactttctacacaacgcgatcaccatccccatatccccttggaaggtgacgtccatcaacaagagcccccaaagggactcagggcggcaccgccgggcagctgggcccctccggctggggggcaacagctcggatttcgagatccaggaggacaaggtgccccgtgagcgagcggtgctgagcggcctgcgccacttcacggaataccggatcgacatccatgcctgcaaccacgcggcgcacaccgtgggctgcagcgccgccaccttcgtctttgcgcgcaccatgccccacagagaggctgatggtattccaggaaaggtggcctgggaggcctccagcaagaacagtgtccttctgcgctggctcgagccaccagaccccaacggactcatcctcaagtacgaaatcaagtaccgccgcttgggagaggaggccacagtgctgtgtgtgtcccgtcttcgatatgcgaagtttgggggagtccacctggccctgctgccccctggaaactactctgccagggttagggcaacctcactggctggcaatggctcttggacagacagtgttgccttctacatccttggcccagaggaggaggatgctggggggctgcatgtcctcctcactgccacccctgtggggctcacgctgctcatcgttcttgctgcccttggtttcttctacggcaagaagagaaacagaaccctgtatgcttctgtgaatccagagtacttcagcgcctctgatagtaggtccctgatgaatgggaggtgcctcgggagcagatctcgataatccgggaactgggccagggctcttttgggatggtatatgaggggctggcacgaggacttgaggctggagaggagtccacacccgtggccctgaagacggtgaatgagctggccagcccacgggaatgcattgagttcctcaaggaagcttctgtcatgaaagccttcaagtgtcaccatgtggtgcgtctcctgggtgtggtatctcagggccagccaactctggtcatcatggagttaatgacccgtggggacctcaagagccatcttcgatctttgcggcctgaggcagagaacaaccctgggctcccacagccagcattgggggaaatgatccaaatggctggtgagattgcagacggcatggcctaccttgctgccaacaagtttgtgcaccgagatctagcagcccgcaactgcatggtgtcccaggacttcaccgtcaagatcggggacttcgggatgactcgggacgtgtatgagacagactattaccgcaagggtgggaaggggctgctgcccgtgcgctggatggcccccgagtccctcaaagatgggatcttcaccacccactcggatgtctggtcctttggcgtggtactctgggagattgtgaccctggcagaacaaccctaccagggcctgtccaatgagcaggtgctgaagttcgtcatggatggcggggtcctggaggagctggagggctgtccccttcagctgcaggagctgatgagccgctgctggcagccgaacccacgcctgcgcccatctttcacacacattctggacagcatacaggaggagctgcggccctccttccgcctcctctccttctactacagcccggaatgccggggggcccggggctccctgcctaccaccgatgcagagcctgactcctcacccactccaagagactgcagccctcaaaatgggggtccagggcactga

SEQ ID NO: 108 - DNA, 1330 bp, Homo sapiens
cggccgccggcagggttcgcgaggcacccacgctcctaaaaagagcacgacgcacccgatgctcggattggatgaagtgcaaagctttaatccctggaaaggccacgaacaatgaatccatttcatgcatcttgttggaacacctctgccgaacttttaaacaaatcctggaataaagagtttgcttatcaaactgccagtgtggtggatacagtcatcctcccttccatgattgggattatctgttcaacagggctggttggcaacatcctcattgtattcactataataagatccaggaaaaaaacagtccctgacatctatatctgcaacctggctgtggctgatttggtccacatagttggaatgccttttcttattcaccaatgggcccgagggggagagtgggtgtttggggggcctctctgcaccatcatcacatccctggatacttgtaaccaatttgcctgtagtgccatcatgactgtaatgagtgtggacaggtactttgccctcgtccaaccatttcgactgacacgttggagaacaaggtacaagaccatccggatcaatttgggcctttgggcagcttcctttatcctggcattgcctgtctgggtctactcgaaggtcatcaaatttaaagacggtgttgagagttgtgcttttgatttgacatcccctgacgatgtactctggtatacactttatttgacgataacaactttttttttccctctacccttgattttggtgtgctatattttaattttatgctatacttgggagatgtatcaacagaataaggatgccagatgctgcaatcccagtgtaccaaaacagaragtgatgaagttgacaaagatggtgctggtgctggtggtagtctttatcctgagtgctgccccttatcatgtgatacaactggtgaacttacagatggaacagcccacactggccttctatgtgggttattacctctccatctgtctcagctatgccagcagcagcattaacccttttctctacatcctgctgagtggaaatttccagaaacgtctgcctcaaatccaaagaagagcgactgagaaggaaatcaacaatatgggaaacactctgaaatcacacttttaggaaagtacatggatcaccatgagtctagacatgattgtctatcttactggtattattagaaagggcaggtgtaccgatatgtttatgcccattcttcttgtgtacttgtgactcttagcagcatggaagagaagtgtaaccatgcaaatacaatgagcttaatatgctaactgtaaaaaaaaaaaaaaaaaaaaaa

SEQ ID NO: 109 - DNA, 1632 bp, Homo sapiens
gccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgta

SEQ ID NO: 110 - DNA, 1487 bp, Homo sapiens
gccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgta

SEQ ID NO: 111 - DNA, 1847 bp, Homo sapiens
gcttcctctcagcccgctctgagctggaagcagcatgtgggacctggccctgatcttcctcgcagcagcctgagtgttctcactaggggtcactctgtgggtcatttgcagccattttttcactgtgcacatccctgcagcggttggccaccctgtgaaactgagagtcctccattgcatcttccagctgctgttgacatgggggatgatatttgagaagctcagaatctgttctatgccccaatttttctgtttcatgcaagatctgcctccgctaaagtatgatcccgatgttgtggtcacggatttccgctttgggacaatccctgtgaagctgtaccaatccaaggcatccacctgcaccctgaagcctggcatcgtgtactaccacggtggcgggggcgtcatggggagtttgaaaacccaccatggcatatgctctcgtttgtgcaaggagagtgactccgtggttctggcagttggttaccgcaagttacctaagcataagtttccagtgccagtaagagactgcttggtggccaccatccacttcctgaagtccctggatgcatatggagtggatccagcccgggttgtggtctgcggtgacagtttcggaggggcaatagccgcagtggtttgtcaacaacttgtggacaggccagatctgccccggatccgggctcagatcctgatctatgccattctccaagccctggatttacaaaccccttcgtttcaacagaggaaaaacatcccactgctcacctggagtttcatctgctactgtttttttcaaaacctggatttcagctcctcctggcaagaggtcatcatgaaaggtgcccatttgcctgctgaagtctgggaaaagtacagaaagtggttgggcccagaaaacatccctgagaggtttaaggagaggggttaccaactgaagccccatgagcccatgaatgaagctgcttacttggaagtaagtgttgtcctggatgtgatgtgctcgcccctgattgcagaagatgacatagtgtctcagctcccggaaacctgcatcgtgagctgtgagtatgatgctctccgggacaattcactgttgtacaagaaaaggctggaagacctgggagtgcccgtgacctggcaccatatggaggatggtttccatggagtgctcaggaccattgacatgagcttcttgcactttccctgctccatgagaattctgagtgcattagttcaatttgtaaagggactgtgaccatctttcttctctgctggtactgcggtgtggattccactggcatccagcctcccacagggctctctgttgctgatttaggtggtgcatagtggggctagggaggaggtagaggttgctgtcacctttctggtccaggttctagaaccacacaatgcatgctcctgatgtccagaggacgtggtagaaaagacaggtttggaggtgggagtgtggctgtctctattctctgttgggaaaacctgggctgacaatattcagtggccatttgtgggagtgaatcagccggtaagagctgttctcagcctctctaaggggcagttcaggctcccagattgatccagactgtgtgtgactttcgtccatttgacttgactttggaatagcacaagggcatcacgtacttcacgaggctttcccaatgtggctcagaggcaggagctctgatgctctaggctgctgtgaggtggtggtggtggtggagaaactggcttcacccacctactcttctgtgaacagtagtgacttttcccgctgtttctcagcctctgggatcagagtcttcactgtctgggctggaaactttaag

SEQ ID NO: 112 - DNA, 2947 bp, Homo sapiens
ctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagcggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttcttttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttccgatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacatggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 113 - DNA, 2722 bp, Homo sapiens
ggctgggacccaatatggcttctcctttttccacacacaagagctcagggatcctccattctggcgtctctcacctccttcatcccctacctcctgcagctccagtgccctgagctcccagccacagtgctcactgctggctctggttatccactaccagctgcaccacaagcagctccagctgctccactctgacaccgaatcaattctgagagggcagccccagggggtcagggatgagccaagggaagagagacaggctaggagttgactgcctgttggcctactggctctggtgggaagatacccatgatgttccctattattgtcattttctggaaggagccagtatcttcctcacctctcggccttcccacttgctgtgcctcccaccagaaacactctttctgtacttcatgtaactgccaaccagctctacctgactcctgctgcaacatcttctcctccaggaaggcttcctagatgccccgagtctgggtcaggtgcctcctgtgagcctcctctctgctctgtgccctatgcacccccaactgcaccccagccacaccatgtcaatgtttgtgtccaccaccagccagaagagcagggatggtgttatctttgttgcccagtgtacccagtacacattagatgcccaacacatgtttcttaaatgagtcctcaaggtcaccagcaccagtgaccttgagcaggacctgtcctgggaaatgcagactctctgtcagtataatattcagataacttagacattgaagatccttgaattgggatccctactgtctggagttgtctggcaccgtccttgtggaattgactcatctgtaaaagggagttaagggtacatcaatatcccgtgtccataaatttagaggtgactggagaactctcacataagcggccacctcacttcactggctggatcatggggcagctctttcccaagcccggcgagtgcctgcatgcaagaaggcgggattccttctgccagcagttagcatggcacctgctgtgtaagcatcttaaacatgtgcctagatgcgggaggccagatgcgcaagatggacactcggctcctccttcgtccccgcctctcctcgcttccagggtagcagcctcaacaagggaaactattgttccagtggaggctgcgaggatgtcggtgatttacgcgccgagctgtagctgcaaaaggacaagggcaagtgccggcccgacctaggtgagtgcagctggggtcccgagggtagcgtcccagagccgcgggctgggaggcgctgtggatggcagcggggcgctgtgagagtatcaagaggtactgaggctagacaatgggagggacttcccagtgaggagggagtgagaagtgatagctctgtgcacccggagacgcaaacacgcccaaccctggggccaccgggccgaggctgatgggagacaatgggagacggctttgatgagtggagaaacaccagggttttttgttttctgttgaattggataaaatgacagcaacacacgtggagtgaatttaaggagcggagagtttaataggcagcatgaaggaaggagctttcttttacagagacagagggaggagggctctatagccgagataggaaacctggagtgccccgagatactagccagttatatgaggagtcggtgtttgatatgcttagggtattggtttgaccaggaatattgttcccatagtctttgaaaaaactgacccttgcaccttagccttttaatatgcaaacacaggggccctgatgttctatacacgtggggatatgtcgaggtggccatgttgccaggcaaatatgggggcaagggcaagaggaaaaccgtgagaatcgccatgtttgggtggacccagtttctaatggtgtgcatttgcatgtcaaaggttgccagcgggctcttagctaggctttcctgctagacaagaagcgttcctggagctgctttagaagagatgaaagcttttcaaggaccctttttcccctctatctgcctgaaataatttcctaataactcctgtaacattcctccttctgaacaagttaaccctaactgctgttagggtgtttagggccaccacattttctcactgctttctgctgaaaagggacgctgaatggggaacagcagctaaggcttctccgggggttttaagggtccttggaagaatggcatattcatgcgtggtttagtttgcagcaccattgggagctggattgcttttaggcaagaagaaacaatttgacttatagtattgttagatatgagctgtaaatttctcttcaaaaaatcagtatgtatgttcaattctttgctttctacttttaaacttaacatccttgtagcacaacgtttttcgattacctgctccaccctgactcattccgattacctgctctgccctgactcattttccaccctgactctttctgatttcctgctctgccataaccatttttccagccaaaccactcacccgtacactatctttaaattagccaattggaattagtttagcctgtgcatctaaccctagccaataggggaacacagcagcagggtccacgtggatcgggaataagaacctcctctcctcccttgtccaggtgtgtgctcactattgctccaaatgtaagggggcacccttctatagaattacattgccttgctgagaatt

SEQ ID NO: 114 - DNA, 4476 bp, Homo sapiens
gcagcggcggcagccagaacaggagcagcgatagctcgggtttccggaacaggagccggggcagcggcggcagctcagtgctgggcacctgtgcggagcaggagtagcaggaccacggggtggggtcggcgccagccactctgagccagagaaggaaggggcatctcccagattccactgctgggaataatctccaggggaggtggcgctgaactgggaatactggtgggggtgaacatgtgcaggaacagctagaggcctcggggcaggaaaacatttggttcacgtgtaaacaggcaaggaaagctgtctgggaccatggcagcctcccgcctggactttggggaggtggaaactttcctggacaggcacccagagttgtttgaagattacttgatgcggaaggggaagcaggagatggttgaaaagtggctgcagaggcacagtcagggtcagggggctttaggtccaaggccctctttggctggtaccagcagcttggctcacagcacctgcagaggtggcagcagcgttggtggtggcactggaccaaatggctctgcccacagccagccccttcccggtggcggggactgtggtggggttcccttgagtcccagctgggccggtggcagcaggggcgatgggaacctgcagcggagagcttctcagaaagagctaaggaagagttttgcccgctccaaggccatccacgtgaacaggacctacgatgaacaggtgacctcccgggctcaggaacccctgagtagtgtacgacggagggcacttctccggaaggcaagctccctgccccccaccacagcccatattctcagtgcgctgctggaatcgagagtgaatctgcctcagtatccccctacagccatcgactacaagtgccatctgaaaaagcataatgagcgtcagttctttctggaattggtcaaagatatctccaatgaccttgacctcaccagcctgagctacaagattctcatctttgtctgccttatggtggatgctgaccgctgctctcttttcctggtggaaggggcagctgctggcaagaagaccttggtctccaaattctttgatgtgcatgcaggaacccctctgctgccttgcagcagcacagagaactcaaatgaggtgcaggtcccctggggcaaaggtatcattggctatgtcggggagcatggagaaacggtcaacattcctgatgcctaccaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaaccatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcattttgtatagggcttttctgtttgttacaagccaaacattgcctgtctttgcttcccgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagaataagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcgcttaacttctacaagcttgtttccttatttgtcaaattagattacactaggaaacgattctcgaacatgttttaaccttacaactctttgttcaaataaatctttcaatgaatccccaacataaaaaaaaaaaaaaaaaaaaaaaaaaaaaa

SEQ ID NO: 115 - DNA, 1620 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 116 - DNA, 1632 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 117 - DNA, 2584 bp, Homo sapiens
gcaggcggcaatgtggggactcggggcccggggccccgaccgggggctgctgctggcgctggcgctgggcgggctggcgcgggccgggggcgtcgaggtggagcccggcggcgcgcacggcgagagcgggggcttccaggtggtcaccttcgagtgggcccacgtgcaggatccctacgtcatcgcgctctggatcctcgtggccagcttggccaagatcgggttccacctgtcccacaaggtcaccagcgtggttcccgagagcgccctgctcatcgtgctgggcctggtgctgggcggcatcgtctgggcggccgaccacatcgcgtccttcacactgacgcccaccgtcttcttcttctacctgctgccccccatcgtgctggacgccggctacttcatgcccaaccgcctcttcttcggcaacctggggaccatcctgttgtacgccgtcgtgggtaccgtgtggaacgcggccaccaccgggctgtccctctacggcgtcttcctcagtgggctcatgggcgacctgcagattgggctgctggacttcctcctgtttggcagcctcatggcggctgtggacccggtggccgtcctggccgtgtttgaggaggtccatgtcaacgaggtcctgttcatcatcgtcttcggggagtcgctgctgaacgacgcagtcaccgtggttctgtacaatgtgtttgaatctttcgtggcgctgggaggtgacaacgtgactggcgtggactgcgtgaagggcatagtgtccttcttcgtggtgagcctggggggcacgctggtgggggtggtcttcgccttcctgctgtcgctggtgacgcgcttcaccaagcatgtgcgtatcatcgagcccggcttcgtgttcatcatctcctacctgtcctacctgacgtccgagatgctgtcgctgtcggccatcctcgccatcaccttctgtggcatctgctgtcagaagtatgtgaaggccaacatctcggagcagtcggccaccaccgtgcgctacaccatgaagatgctggccagcagcgccgagaccatcatcttcatgttcctgggtatctcggccgtgaacccgttcatctggacctggaacacggccttcgtgctcctgacgctggtcttcatctccgtgtaccgggccatcggtgtggtcctgcagacctggcttctgaaccgctaccgcatggtgcagctggagcccattgaccaggtggtcctgtcctacgggggcctgcgcggggccgtggcctttgccctggtggtgcttctggatggagacaaggtcaaggagaagaacctgttcgtcagcaccaccatcatcgtagtgttcttcaccgtcatcttccagggcctgaccatcaagcctctggtgcagtggctgaaggtgaagaggagcgagcaccgggaacctcggctcaacgagaagctgcacggccgcgctttcgaccacatcctctcggccatcgaggacatatccggacagatcgggcacaattatctcagagacaagtggtcccacttcgacaggaagttcctcagcagggtcctcatgagacggtcggcccagaagtctcgagaccggatcctgaatgtcttccacgagctgaacctgaaggatgccatcagctacgtggctgagggagagcgccgcgggtccctggccttcatccgctcccccagcaccgacaacgtggtcaacgtggacttcacgccacgatcgtccaccgtggaggcctctgtctcctacctcctgagagaaaatgtcagcgctgtctgcctggacatgcagtctctggagcagcgacggcggagcatccgggacgcggaggacatggtcacgcaccacacgctacagcagtacctgtacaagccgcggcaggagtacaagcatctgtacagccgacacgagctcacgcccacggaggacgagaaacaggaccgggaaatcttccacaggaccatgcggaagcgcctggagtccttcaagtcgaccaagctggggctcaaccagaacaagaaggcagccaagctgtacaagcgggagcgtgcccagaagcggagaaacagcagcatccccaatgggaagctgcccatggagagccctgcgcagaatttcaccatcaaggagaaagacttggaactttcagacaccgaggagccccccaactatgatgaggagatgagtggggggatcgagttcctggctagtgtcaccaaggacacagcgtccgactcccctgcaggaattgacaaccctgtgttttctccggacgaggccctggaccgcagcctcctggccaggctgccgccctggctgtctcccggggagacggtggtcccctcgcagagggcccgcacgcagattccctactctcccggcaccttccgccgcctgatgcccttccgcctcagcagcaagtccgtggactccttcctgcaggcagacggccccgaggagcggccccccgccgccctccccgagtccacacacatgtgacaccggctccgacacgccgctaaccggccgctcgtccccgcgccacggtccgcccaccgccgccgccgc

SEQ ID NO: 118 - DNA, 2147 bp, Homo sapiens
gcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaaaaaaaaaaaaaaaaa

SEQ ID NO: 119 - DNA, 2243 bp, Homo sapiens
gcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaaaaaaaaaaaaaaaaa

SEQ ID NO: 120 - DNA, 4516 bp, Homo sapiens
ctcggcgcgcctggacccctgcccctctctgggtggagaagctcccggccgcttcccggtttcactccttctcagcctgggctcccagcccctctctccttttcctggactggctctcacccccttcggtccccttcctttagctcaggctccctaccccttcctttagcccacagcccagagtcccagctcctcagtcactttcctcagccaaaggtcccagccttccttcttcctttcctttgcactatccctatcctgccccttcctctatccctagggctcagtttcccacatccgtcctcccccttcccaggcccggagttccagaccttttggtctcctttcgtggtcgttcctgggtccttgccccctttccccactttggagttccagattgcaaacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcaccatggttctgcggtctggcatctgtggcctctctccacatcggatcttcccttccttactcgtggtggttgctttggtggggctgctgcctgttctcaggagccatggcctccagctcagcccaactgccagcaccattcgaagctcagagccaccacgagaacgctcgattggggatgtcaccaccgctccaccggaggtcaccccagagagccgccctgttaatcattccgtcactgatcatggcatgaagccgcgcaaggcctttccagtcctgggcatcgactacacacacgtgcgcacccccttcgagatctccctctggatccttctggcctgcctcatgaagataggtttccatgtgatccccactatctcaagcatcgtcccggagagctgcctgctgatcgtggtggggctgctggtggggggcctgatcaagggtgtaggcgagacaccccccttcctgcagtccgacgtcttcttcctcttcctgctgccgcccatcatcctggatgcgggctacttcctgccactgcggcagttcacagaaaacctgggcaccatcctgatctttgccgtggtgggcacgctgtggaacgccttcttcctgggcggcctcatgtacgccgtgtgcctggtgggcggtgagcagatcaacaacatcggcctcctggacaacctgctcttcggcagcatcatctcggccgtggaccccgtggcggttctggctgtctttgaggaaattcacatcaatgagctgctgcacatccttgtttttggggagtccttgctcaatgacgccgtcactgtggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgctcatagcctcaggagtggtgatgcgcccctatgtggaggccaacatctcccacaagtcccacaccaccatcaaatacttcctgaagatgtggagcagcgtcagcgagaccctcatcttcatcttcctcggcgtctccacggtggccggctcccaccactggaactggaccttcgtcatcagcaccctgctcttctgcctcatcgcccgcgtgctgggggtgctgggcctgacctggttcatcaacaagttccgtatcgtgaagctgacccccaaggaccagttcatcatcgcctatgggggcctgcgaggggccatcgccttctctctgggctacctcctggacaagaagcacttccccatgtgtgacctgttcctcactgccatcatcactgtcatcttcttcaccgtctttgtgcagggcatgaccattcggcccctggtagacctgttggctgtgaagaaaaagcaagagacgaagcgctccatcaacgaagagatccacacacagttcctggaccaccttctgacaggcatcgaagacatctgtggccactacggtcaccaccactggaaggacaagctcaaccggtttaataagaaatatgtgaagaagtgtctgatagctggcgagcgctccaaggagccccagctcattgccttctaccacaagatggagatgaagcaggccatcgagctggtggagagcgggggcatgggcaagatcccctctgccgtctccaccgtctccatgcagaacatccaccccaagtccctgccttccgagcgcatcctgccagcactgtccaaggacaaggaggaggagatccgcaaaatcctgaggaacaacttgcagaagaccaggcagcggctgcggtcctacaacagacacacgctggtggcagacccctacgaggaagcctggaaccagatgctgctccggaggcagaaggcccggcagctggagcagaagatcaacaactacctgacggtgccagcccacaagctggactcacccaccatgtctcgggcccgcatcggctcagacccactggcctatgagccgaaggaggacctgcctgtcatcaccatcgacccggcttccccgcagtcacccgagtctgtggacctggtgaatgaggagctgaagggcaaagtcttagggttgagccgggatcctgcaaaggtggctgaggaggacgaggacgacgatgggggcatcatgatgcggagcaaggagacttcgtccccaggaaccgacgatgtcttcacccccgcgcccagtgacagccccagctcccagaggatacagcgctgcctcagtgacccaggcccacaccctgagcctggggagggagaaccgttcttccccaaggggcagtaacgccagggccagcaggcagcgcctgtcccctcacagactcttccaccagagcaggggctgctgggggctccccttgcccttcctgacccggattggccctgcccctccccctaccgcatggcagctgggcccacagcccccaccccagcacagctcctcccctgccgcctcccgggaagcatcctccccaccagagctgcctccccaatccatttggcagaactgctggggctggtgaggccggccctgcccctccctagatccaggcttctcccggacctggactagggcctcggaggctcctccctctgcctcatcctcctcctcattcagaccaatcttagtttctaaccaaagagtctctggctcagctgtggtcccacccaggaagggagggagctgaggcctcccttgagtaggccctgctttatcaggggacaaaccaggggtaccaggcacatggctgggggagggactgctgacccaccaaggtctcacactcctcctgccagctctgtcaccctggccaccacccaacctatccttactcagagctgcgggctgagggcatctctgagtgtctctgcctggagcaggggtggtttctacggtgacagtgacgtgactcagagcttttcgaactgtgctcccacggggaccactgggcccctcaggggaagctgctaggggaaggactggccgtggctccagaatgtgctgcctttttaagttttgtttgttcacactcctatatatgattgtttgcacagagggcgctcctgtttttaaaacattttgaaaacccctggctgaacagtgctctgcctctaactccctcctcacactccagaattacccttcctcatctgtgcctgtctgtccaacccctcccccacgtctctctgcctgctgggctcttaactgttgctcgaagactgtgacatcagaagtaactcccactcctaatcaagagtctctccagcctcacagatgctggcctcttggcacctgcctagctcttgggcctgacctccagtcctgctggcctgctcttacttcccccaccctgggtttggcccctggaacctttcccttgtgtgtaccacaccctgcctgctgtggagcccattgtggaggcggtgggggggagaaggcctcccctgaggatcccctgtcccctggggctggtggattgggcagaatcctgggcccccagagacctttgcccacacacactccttccccttgtccctggggcactcccccaggattgtgcaatagtcagagtgtccctttttgcaggggactgggccatgggtcctcggcccatctgtccatcctcctctccatgcaagtgctgtttgggcaggagtcaccatgcaagggtgacatcgacaaccacgtaccaagccaccgcagctgctgccactctgctgcctgtacagaagaaactgaatctttttcatattctaataaatcaatgtgagtttt

SEQ ID NO: 121 - DNA, 1362 bp, Homo sapiens
atggcttcacccagcctcccgggcagtgactgctcccaaatcattgatcacagtcatgtccccgagtttgaggtggccacctggatcaaaatcacccttattctggtgtacctgatcatcttcgtgatgggccttctggggaacagcgccaccattcgggtcacccaggtgctgcagaagaaaggatacttgcagaaggaggtgacagaccacatggtgagtttggcttgctcggacatcttggtgttcctcatcggcatgcccatggagttctacagcatcatctggaatcccctgaccacgtccagctacaccctgtcctgcaagctgcacactttcctcttcgaggcctgcagctacgctacgctgctgcacgtgctgacactcagctttgagcgctacatcgccatctgtcaccccttcaggtacaaggctgtgtcgggaccttgccaggtgaagctgctgattggcttcgtctgggtcacctccgccctggtggcactgcccttgctgtttgccatgggtactgagtaccccctggtgaacgtgcccagccaccggggtctcacttgcaaccgctccagcacccgccaccacgagcagcccgagacctccaatatgtccatctgtaccaacctctccagccgctggaccgtgttccagtccagcatcttcggcgccttcgtggtctacctcgtggtcctgctctccgtagccttcatgtgctggaacatgatgcaggtgctcatgaaaagccagaagggctcgctggccgggggcacgcggcctccgcagctgaggaagtccgagagcgaagagagcaggaccgccaggaggcagaccatcatcttcctgaggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 122 - DNA, 1723 bp, Homo sapiens
tgctacccgcgcccgggcttctggggtgttccccaaccacggcccagccctgccacaccccccgcccccggcctccgcagctcggcatgggcgcgggggtgctcgtcctgggcgcctccgagcccggtaacctgtcgtcggccgcaccgctccccgacggcgcggccaccgcggcgcggctgctggtgcccgcgtcgccgcccgcctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccgctgggagtacggctccttcttctgcgagctgtggacctcagtggacgtgctgtgcgtgacggccagcatcgagaccctgtgtgtcattgccctggaccgctacctcgccatcacctcgcccttccgctaccagagcctgctgacgcgcgcgcgggcgcggggcctcgtgtgcaccgtgtgggccatctcggccctggtgtccttcctgcccatcctcatgcactggtggcgggcggagagcgacgaggcgcgccgctgctacaacgaccccaagtgctgcgacttcgtcaccaaccgggcctacgccatcgcctcgtccgtagtctccttctacgtgcccctgtgcatcatggccttcgtgtacctgcgggtgttccgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctacgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagccgtgccgccccggcttcgcctcggaatccaaggtgtagggcccggcgcggggcgcggactccgggcacggcttcccaggggaacgaggagatctgtgtttacttaagaccgatagcaggtgaactcgaagcccacaatcctcgtctgaatcatccgaggcaaagagaaaagccacggaccgttgcacaaaaaggaaagtttgggaagggatgggagagtggcttgctgatgttccttgttg

SEQ ID NO: 123 - DNA, 1856 bp, Homo sapiens
ctgacttggcaggactgtgcaattgtcagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactcta

SEQ ID NO: 124 - DNA, 3742 bp, Homo sapiens
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaa

SEQ ID NO: 125 - DNA, 1796 bp, Homo sapiens
gcctggagctagcctgggggcgagccagggtcccccaacccccgggatgaccgcggccagccgggccaacccctacagcatcgtgtcatcggaggaggacgggctgcacctggtcaccatgtcgggcgccaacggcttcggcaacggcaaggtgcacacgcggcgcaggtgccgcaaccgcttcgtcaagaagaatggccagtgcaacattgagttcgccaacatggacgagaagtcacagcgctacctggctgacatgttcaccacctgtgtggacatccgctggcggtacatgctgctcatcttctcgctggccttccttgcctcctggctgctgttcggcatcatcttctgggtcatcgcggtggcacacggtgacctggagccggctgagggccggggccgcacaccctgtgtgatgcaggtgcacggcttcatggcggccttcctcttctccatcgagacgcagaccaccatcggctacgggctgcgctgtgtgacggaggagtgcccggtggccgtcttcatggtggtggcccagtccatcgtgggctgcatcatcgactccttcatgattggtgccatcatggccaagatggcaaggcccaagaagcgggcacagacgctgctgttcagccacaacgccgtggtggccctgcgtgacggcaagctctgcctcatgtggcgtgtgggtaacctgcgcaagagccacattgtggaggcccatgtgcgcgcgcagctcatcaagccgcgggtcaccgaggagggcgagtacatcccgctggaccagatcgacatcgatgtgggcttcgacaagggcctggaccgcatctttctggtgtcgcccatcaccatcttgcatgagattgacgaggccagcccgctcttcggcatcagccggcaggacctggagacggacgactttgagatcgtggtcatcctggaaggcatggtggaggccacagccatgaccacccaggcccgcagctcctacctggccaatgagatcctgtggggtcaccgctttgagcccgtgctcttcgaggagaagaaccagtacaagattgactactcgcacttccacaagacctatgaggtgccctctacgccccgctgcagtgcgaaggatctggtagagaacaagttcctgctgcccagcgccaactccttctgctacgagaacgagctggccttcctgagccgtgacgaggaggatgaggcggacggagaccaggacggccgaagccgggacggcctcagcccccaggccaggcatgactttgacagactccaggctggcggcggggtcctggagcagcggccctacagacgggagtcagagatctgagccaaccttggccgacatgcagcatccacccccggctggggagaggccccgcggtcgctcaggggccccgggtttgagcagaacgggcccagtgccctgggttgcagactcagtagcgttttagtcgttttatgtttctttgcaacggcctcagaagtttggccggagagggggcagccagagcggcagcccccggcctcagaggctatcacaggctcagggcaaagaagtggcctcctggggggccaggccacgagggccagggcttctgcctgaagatggagctgcagcctgcggggaagcagctcagctcgatggtgggcccagcctctgctgtccaaggctggctagctgcggtgctccttgctggtttttaacttggggagaaacaccgggtttcagctttcttgaccttagcttgggtgagactgtttacaaaaaaaaaaaa

SEQ ID NO: 126 - DNA, 2963 bp, Homo sapiens
cgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagcagctcctcgtgcctggcggcgtgggcccgggcgagcagccctgcctccggacgctttaccgatttgttacaactcaagcaagggccagcagaaattctcttttgacagatataattgctgcttatcaaagattctgttctcgacccccaaaaggatttggaaaatactttcctaatggaaaaaatggaaaaaaagctagtgaacctaaagaagttatgggagagaaaaaagaatcaaagccagctgctaccacacgctcttctggaggaggaggtggtggcggtggaaaacgaggtggcaagaaagatgattctcactggtggtccaggtttcagaagggtgacattccatgggacgacaaggatttcaggatgttcttcctctggactgctctgttctggggtggagtcatgttttacttgctgctcaagagatccgggagagaaatcacttggaaggactttgtcaataactatctttcaaaaggagtagtagacagattggaagtcgtcaacaagcgttttgttcgagtgacctttacaccaggaaaaactcctgttgatgggcaatacgtttggtttaatattggcagtgtggacacctttgaacggaatctggaaactttacagcaggaattgggcatagaaggagaaaatcgggtgcctgttgtctacattgctgaaagtgatggctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaagggtgccattctcactggtcctccaggcactgggaagacgctgctagctaaggccacagccggagaagccaatgtccccttcatcaccgttagtggatctgagtttttggagatgttcgttggtgtgggccctgctagagtccgagacttatttgcccttgctcggaagaatgccccttgcatcctcttcatcgatgaaatcgatgcggtgggaaggaagagaggaagaggcaactttggagggcagagtgagcaggagaacacactcaaccagctgctggtggagatggatggttttaatacaacaacaaatgtcgtcattttggccggcaccaatcgaccagatatcctggaccccgcgctacttaggccggggcgtttcgacaggcagatctttattggaccaccagacataaaaggaagagcttctattttcaaagttcatctccgaccgctaaaactggacagtaccctggagaaggataaattggcaagaaaactggcatctttaactccagggttttcaggtgctgatgttgctaatgtctgtaatgaagctgcgttgattgctgcaaggcatctgtcagattccataaatcagaaacactttgaacaggcaattgagcgagtgattggtggcttagagaagaaaacgcaggttctgcagcctgaggagaagaagactgtggcataccacgaagcaggccatgcggttgccggctggtatctggagcacgcagacccgcttttaaaggtatccatcatcccacgtggcaaaggactaggttatgctcagtatttaccaaaagaacaatacctctataccaaagagcagctcttggataggatgtgtatgactttaggtggtcgagcctctgaagaaatcttctttggaagaattacaactggtgctcaagatgacttgagaaaagtaactcagagtgcatatgcccaaattgttcagtttggcatgaatgaaaaggttgggcaaatctcctttgacctcccacgtcagggggacatggtattggagaaaccttacagtgaagccactgcaagattgatagatgatgaagtacgaatacttattaatgatgcttataaaagaacagtagctcttctcacagaaaagaaagctgacgtggagaaggttgctcttctgttgttagaaaaagaagtattagataagaatgatatggttgaacttttgggccccagaccatttgcggaaaaatctacctatgaagaatttgtggaaggcactggcagcttggatgaggacacctcacttccagaaggccttaaggactggaacaaggagcgggaaaaggagaaagaggagcccccgggtgagaaagttgccaactagaggcccagagggaggccatctcagtctctccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacatttt

SEQ ID NO: 127 - DNA, 3884 bp, Homo sapiens
ggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggacggacatggcaaccacagagagagcagcccttttctttcccccttggaggcttccagaggaattgactactatgacaggaacctggcactgtttgaggaagagctggacatccgcccaaaggtatcgtctcttctgggaaagctcgtcagctacaccaacctcacccagggcgccaaagagcatgaggaggccgagagtggggagggcacccgccggagggcagccgaggcacccagcatgggcaccctcatgggggtgtacctgccctgcctgcagaatatctttggggttatcctcttcctgcggctgacctggatggtgggcacagcaggtgtgctacaggccctcctcatcgtgcttatctgctgctgttgtaccctgctgacggccatctccatgagtgccatcgccaccaacggtgtggttccagctgggggctcctatttcatgatctctcgttcactggggccagaatttggaggtgctgtgggcctgtgcttctacctgggaacaacattcgcagcagccatgtacatcctgggggccatcgagatcttgctgacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccaggaaaacctgtggagcgcctacctggagaagggtgacatcgtggagaagcatgggctgccctccgcagatgccccgagcctgaaggagagcctgcctctgtacgtggtcgctgacatcgccacatccttcaccgtgctggtcggcatcttcttcccttctgtaacaggcatcatggctggctcaaaccgctctggggaccttcgtgacgcccagaagtctatccctgtggggaccattctggccatcattacaacttccctcgtgtacttcagcagtgtggttctctttggtgcctgcattgagggtgtggttctccgggacaagtatggcgatggtgtcagcaggaacttggtggtgggcacactggcctggccttcaccctgggtcatcgtcatcggctccttcttttcaacgtgtggcgctggcctccagagcctcacaggggcaccacgcctattgcaggccattgccaaggacaacatcatccccttcctccgggtgtttggccacgggaaggtgaatggtgaacccacatgggcactcctcctgacggcactcatcgccgagctgggcatcctcatcgcctccctcgacatggtggcccccatcttatccatgttctttctgatgtgctacctgttcgtgaacctcgcctgtgcggtgcagacactcctgaggacccccaactggcggccccggttcaagtactatcactgggcgctgtccttcctgggcatgagtctctgcctggcccttatgtttgtctcctcctggtactatgccctggtggccatgctcatcgccggcatgatctacaaatacatcgagtaccaaggggctgagaaggagtggggtgacgggatccgaggcctgtccctgagcgctgcccgctacgcgctgttgcggctggaggaggggcctcctcacaccaagaactggcggccgcagctgctggtgctgctgaagctggacgaggacctccacgtgaagtacccgcggctcctcaccttcgcctcccagctcaaggctggcaagggcctgaccattgttggttctgtcatccaggggagcttcttggagagctatggcgaggctcaggccgccgagcagaccatcaagaacatgatggaaattgagaaggtgaagggcttctgccaggtggtggtggccagcaaggtgcgggaggggctggcccacctcatccagtcctgtggcctgggaggcatgcggcataactccgtggtgctgggctggccctacggctggcgacagagcgaggacccccgtgcctggaagaccttcattgacaccgtgcgctgcactacggctgcccacctggccctgctcgtgcccaagaacatcgccttctaccccagcaaccacgagcgctacctggagggccacatagacgtgtggtggatcgtgcacgatggtggcatgctcatgcttctgcccttcctgctgcgccagcataaggtctggaggaagtgccggatgcgcatcttcacagtggcccagatggatgacaacagcatccagatgaagaaggacctggctgtctttctgtaccatctgcgccttgaggccgaggtggaggtggtggagatgcataacagtgacatctctgcatacacctacgagcggacgctgatgatggagcagcggtcgcagatgctgcggcagatgagactgaccaagactgagcgggagcgagaagcccagctggtcaaggatcggcactcggccctgaggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcaaaaaaaaaaaaaaaaaaaaaaaaaaaaaaaaaaaaaaaaaaaa

SEQ ID NO: 128 - DNA, 1998 bp, Homo sapiens
gcgcgcgcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacttgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctgggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaaaaaaaaa

SEQ ID NO: 129 - DNA, 2772 bp, Homo sapiens
cagtcggcaccggcgaggccgtgctggaacccgggcctcagccgcagccgcagcggggccgacatgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccgggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatgaaaaaaaaaaaaaaaaaaaaaaaaaaaaaaaaaaaaaaa

SEQ ID NO: 130 - DNA, 1702 bp, Homo sapiens
gcccttagagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgc

SEQ ID NO: 131 - DNA, 1816 bp, Homo sapiens
caggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacagtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtagggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgc

SEQ ID NO: 132 - DNA, 2924 bp, Homo sapiens
ggcttctggttcggcccacctctgaaggttccagaatcgatagtgaattcgtggttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagag

SEQ ID NO: 133 - DNA, 2820 bp, Homo sapiens
gcagagtgttgctgtgtgtgcttgtgatttgtattttatttgatgtaaacgtgaaggcagagtattttctaacactgtaattcaactaggttttgtgtctcctggatctatttttttttcttgttgttctgaggagctgatatacttggaaatattaggtttaagatatgcagatgtccaacttatatacatagtcaagggtttagagtctggagacaggaggctggcaatttcaactagggggcaggtcaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatatgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggagctcttcttgtgaaatgtctgttccagctgttgtgactgctgccatttttggaaacatctgcccaatcctgggtgatcaccacatcttttaggggaagtgacaagatgctctggtcatactctttttcccaactttggaaaacataaaaatcactcatataacagctcaaagagtaaaacatttggttcttctgacacttgtggtatagtattagtggaaagtgatttgtaatatgattttatatccacctacctattcatctacctgtgtgtatgtgtgtgtttgtgtgtctatttggcaattcacaagtcctgccaagtggtttctatgagcatctctgtttggtaaggaggacaattgtcagttttgagggggacatgtgttaaatcacagaaaaaaatggtgccttcttctgcgtttgtccctcctgccatgtgtaagttgtaaggattgcctttgtagttaatgtactctttggctttgtttgtttgttttcttcttcagtgaagcagccttactattcatagaagggctagaataggagaaaatgaaaggtagtgagtaattctttgataagatgaggaaataatgggaaaggttgaattaattcctgggcatggactaccagatgaccacaagttgcgttgaggccgcatctttcttcagcagcgtgcaatagctggctcctctataggagatgagcttcattgggagttcctagcaagttgactaaacagcaaaagttctttctcgtgggtaaatatacccacaggttctatgatttgtagctctaggtttcttgatgatcaaggagtgaagtaattgacagggaaaatatagacctatgataaataaccaggaagcattgcttttggacaaggaagaacagagggttttgattttaaaaagaagaaaaaaaaaccttattttttctttcttggcctcaagttcaatatggagaggattgcttccctgaatcctctcttccttccccttttagag

SEQ ID NO: 134 - DNA, 3960 bp, Homo sapiens
cacaggctgagcagtcaggcccacagcatctgaccccaggcccagctcgtcctggctggcctgggtcggcctctggagtatggtctggcgggtgccccctttcttgctccccatcctcttcttggcttctcatgtgggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggagcccacctgcttccagacaaggtcacacacactgtgaacaaaggtgacaccgctgtactttctgcacgtgtgcacaaggagaagcagacagacgtgatctggaagagcaacggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggttgtggggctgggcgctgggggccaggctgtaccaaggagtgcccaggttgcctacatggaggtgtctgccacgaccatgacggcgaatgtgtatgcccccctggcttcactggcacccgctgtgaacaggcctgcagagagggccgttttgggcagagctgccaggagcagtgcccaggcatatcaggctgccggggcctcaccttctgcctcccagacccctatggctgctcttgtggatctggctggagaggaagccagtgccaagaagcttgtgcccctggtcattttggggctgattgccgactccagtgccagtgtcagaatggtggcacttgtgaccggttcagtggttgtgtctgcccctctgggtggcatggagtgcactgtgagaagtcagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctgtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtggtggaccccagtgagaacgtgacgttaatgaacctgaggccaaagacaggatacagtgttcgtgtgcagctgagccggccaggggaaggaggagagggggcctgggggcctcccaccctcatgaccacagactgtcctgagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtgggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacgggctgcaggctgagggcccagtccaagagagccgggcagctgaagagggcctggatcagcagctgatcctggcggtggtgggctccgtgtctgccacctgcctcaccatcctggccgcccttttaaccctggtgtgcatccgcagaagctgcctgcatcggagacgcaccttcacctaccagtcaggctcgggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaagagtatgcctctgaaaatgaccatcgtgactttgcgggagaactggaagttctgtgcaaattggggcatcaccccaacatcatcaacctcctgggggcctgtaagaaccgaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcagttcatccacagggacctggctgcccggaatgtgctggtcggagagaacctagcctccaagattgcagacttcggcctttctcggggagaggaggtttatgtgaagaagacgatggggcgtctccctgtgcgctggatggccattgagtccctgaactacagtgtctataccaccaagagtgatgtctggtcctttggagtccttctttgggagatagtgagccttggaggtacaccctactgtggcatgacctgtgccgagctctatgaaaagctgccccagggctaccgcatggagcagcctcgaaactgtgacgatgaagtgtacgagctgatgcgtcagtgctggcgggaccgtccctatgagcgacccccctttgcccagattgcgctacagctaggccgcatgctggaagccaggaaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctccaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 135 - DNA, 4590 bp, Homo sapiens
aggagagcctcccggtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaagtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 136 - DNA, 4862 bp, Homo sapiens
actgggataaagcaagaagactgattttatgagcaggggtttgatacatcaaaggagattgcccaggatcaagggtgcggtgttgggggtgggttggggagggtggttagagaaggtttcactaagtgatttgggcctgaggcctgagaagatgtttaaaaagagggatcaagcacaggctaaggagaggaaagagcaggcacccaaacctctgcatggccccaatatgctccctgcagggtagtgccccctcttctggctgctcaaggcgagatctaagcttcttctaactcctgctgtcttttcatattctctgattctgggaaacgaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaagtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 137 - DNA, 4476 bp, Homo sapiens
aggagagcctcccggtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaagtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 138 - DNA, 4737 bp, Homo sapiens
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataa

SEQ ID NO: 139 - DNA, 4641 bp, Homo sapiens
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataa

SEQ ID NO: 140 - DNA, 755 bp, Homo sapiens
cccgcccacatcatgacgcccgaggagaacgcgggtaccaaactcttgctgcagggttttgagagccgcttcctagtggcgcgcacactgcgctccttcccctggcagagcttagaggcaaagttaagagactcatcagattctgagctgctgcaggatattttgcagaagactgtgaggcatcctgtgtgtgtgaagcacccgccgtcagtcaagtatgcctggtgctttctctcagaactcatcaaaaagcacgaggctgtccacacggagcctttggatgagctgtacgaggcgctggcggagaccctgatggccaaggagtccccccagggccaccggagctatttgttgccctcgggaggctcggtcacactctccgaaagcatggccatcatctcccacagcaccacgggtctggtcacatgggatgccgccctctacattgcagaatgggccatcgagaacccggcagccttcactcacaggtctgtcttagagcttggcagtggtgccagcctcacaggcctggccatctgcaagatatgccgcccccgggcatacatcttcagcgactgtcacagccgagtcctcgagcagctccaaggaaatgtccttctcaatggcctctcattagaggcagacatcactgccaacttagacagccctagggtgacaatggcccagcgctggactgggacgtagtgacggtccatcagcgctctgccttccagctagatgttgtcattgcagca

SEQ ID NO: 141 - DNA, 2636 bp, Homo sapiens
aaaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggacagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcagggctattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggggtaaaatcaactgcaactttttgatgttaatttttttccctgtgcaattataaactataagcaagttaagtgacaagcaaatgtaataaagactagtttt

SEQ ID NO: 142 - DNA, 1041 bp, Homo sapiens
atgctattcaaacagcaggcgtggctgagacagaagctcctggtgctgggaagccttgccgttgggagtctcctgtatctagtcgccagagttgggagcttggataggctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaa

SEQ ID NO: 143 - DNA, 1278 bp, Homo sapiens
atggagttaagacagtgtctgtctcttaaagttcagtatctgaagaagaaaggagaacaagagttagtggaggtgggtgattggatcctggactggaagctggagaagccttcccagaggaactgtgatatagcccagaccttaaagaatgggtggactggagctaaaaacagacaggtggaccaaggagctggtgaaagtggacgaagcattgtgcagtacagttttaagcaggagggtgtcaccccaagtgttacttcttcaggaaggactgaagtaggttcctcctattactctttctcactagatcctgtaactttcctttgtcatattgaatacaatttgctacaacccatttgccccattgaaggtcgactgggtggagcccgcactcaggctgaattcccacttcgcgccctgcagtttaagcgtggcctgctgcacgagttccggaagggcaacgcttccaaggagcaggttcgcctccatgacctggtccagcagctccccaaggccattatcattggggtgaggaaaggaggcacaagggccctgcttgaaatgctgaacctacatccggcagtagtcaaagcctctcaagaaatccacttttttgataatgatgagaattatggtaagggcattgagtggtataggaaaaagatgcctttttcctaccctcagcaaatcacaattgaaaagagcccagcatattttatcacagaggaggttccagaaaggatttacaaaatgaactcatccatcaagttgttgatcattgtcagggagccaaccacaagagctatttctgattatactcaggtgctagaggggaaggagaggaagaacaaaacttattacaagtttgagaagctggccatagaccctaatacatgcgaagtgaacacaaaatacaaagcagtaagaaccagcatctacaccaaacatctggaaaggtggttgaaatactttccaattgagcaatttcatgtcgtcgatggagatcgcctcatcacggaacctctgccagaacttcagctcgtggagaagttcctaaatctgcctccaaggataagtcaatacaatttatacttcaatgctaccagagggttttactgcttgcggtttaatattatctttaataagtgcctggcgggcagcaaggggcgcattcatccagaggtggacccctctgtcattactaaattgcgcaaattctttcatccttttaatcaaaaattttaccagatcactgggaggacattgaactggccctaa

SEQ ID NO: 144 - DNA, 297 bp, Homo sapiens
atgctttctatttatatcaatatcatattagcatataccatatcacttctggggatattaacctatcgatcccacctgatagcatccctaatatgcctagaaggaataatattatcattattcatcataaatacccttataactttaaatatacatttcaccctagcattcataatacccattaccctcccagtatttgctgcctgcaaagctgcagtgggcctcgccttactagtttcaatctccaacacgtatggcctagattatgtacataacctaaatttacttcaatgctaa

SEQ ID NO: 145 - DNA, 495 bp, Homo sapiens
atgcctcaactagatacttccacacgacctattattactgtatcaacaatcataactttattctccattattcaattaaaactatcaaagttcatttaccacacaccccctacaccaaaaataatcaaaacacaaaaacgcacacacattccacttacccctatactagtaatcatccaaaccattagtccacttattcaactaatggcactagctgtacatttaacagccaacattacagccgaccactctcaaattcgctgtggcccttatccaaacttgtgtcttcatgctattaaaggaataatattatcattattcatcataaatacccttatacctttaaatatacatttcaccctagcattcataatacccattaccctcctagtatttgctgcctgcgaaggcacagcgggccttgccttactagtttcaatctccaacatgtatggcctagactatgtacataacctaaatttacttcaatgctaa

SEQ ID NO: 146 - DNA, 1922 bp, Homo sapiens
atgcggcggcagggaggcgggcggggcgggctgcaggcggggtctggctctggggccagtctgggccacggtcgggacccagtggagggccggactggtcagggttcaggcgggatccggcgtccgagttctggtgggcaggcctggggcaggatctggctctggctgcgggtcctggcccgggtcagggttgggcctcctatccagcccgccccagggcagggttcaatcccgcacttgccgaagtccctggggctggcaagggtgcaagacgcggagggctctatgtcgggaaaggggctctgaagaccacgtgggggcgctctaaggggtctggggccaccctgctctctgggtcaaaggtcatcgcaatggccgggaagaacttcctcttccttggctctccccacttacttcctgataacctggtagcggtctcccgcgggcgtcggggcttggggggaggcgtagcaacttcagggaacttcccaaaggtgtgcgcaggttggggggcggggcgcggcgccccgggaggtggcggcctctgcgacagcggaagtataagagtggacctgcaggccggtcgcgaggaggtggagtgggtggcgcccgctttgtgcctgggatcggcatgctggggcaggagggcagccgcgtgtcaggtgaccagaaccatgtccagccaggtggtgggcagtgagcctctctacatcatggcagagccggccaggcctgacagtccaaagggctcctcggagacggagacccgagcctcctgtggccctggcccctggtccagctcccacccactgcctcccaggccacaaggaagaggaggatgggaaggggctgggcctggcgagctgggcggtgggaagctggtgctcagcttcctgtccaagagcctctgcctggtctgtggggacgtggcctccggctaccactacggtgtgtcatcctgtgaggactgcaaagccttcttcaagaggaccatccaggggagcatcaagtacagctgtccggcctccaacaagtgtgagatcatcaagcggagacgcaaggcctgtcaggcctgccgcttcaccaagtgcctgcgggagtgcgcctggatcgcgtccggggtgggcggaagaagtacaagcggtgccagaggtggacccgctgcccttcccgggcgccttccctgctgggcccctggcagtcgctggaggcccccagaagacaccccagtgaatgcgctggtgtctcatctgctggtggttgagcctgagaagctctatgccatgcccgaccccgtgggccctgatgggcacctttaagccgtggctaccctctgtgacctctttgaccgagagatcgtatttaccgtcagctgggccaagagcatcccaggcttctcattgctgtcgctgtctgaccagatgtcagtactgcagagcgtgtggatggaggtgctggtgcccggtgtggcccagcgctcactgccactgcaggatgagctggccttcactgaggacagagtcctggatgaagagggggcacgggcagctggcctgggggaactggggactgccctgctgcaactggtgcggcggctgcagtccctgcggctggagcgaggggagtacgttctactgaaggccctggcccttgccaattcagactctgtgcccatcgaagatgccgaggctgtggagcagctgccagaagctccgcacgaggccctgctggagtatgaagccggccgggctggcaccggagggggtgctgagcggcggcggccaggcaggctgctgttcacgctaccgctcctccaccagacagcgggcaaagtgctggcccatttctatggggtgaagctggagggcaaggtgcccatgcacaagctgttcttggagatgctcgaggccatgatggactga

SEQ ID NO: 147 - DNA, 944 bp, Homo sapiens
tcaagattaaacgacaaggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 148 - DNA, 1032 bp, Homo sapiens
ggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 149 - DNA, 1104 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 150 - DNA, 939 bp, Homo sapiens
cattccttggtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 151 - DNA, 1331 bp, Homo sapiens
ggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 152 - DNA, 929 bp, Homo sapiens
agggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 153 - DNA, 2662 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatgcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaaaaaaaaaaa

SEQ ID NO: 154 - DNA, 2699 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggctgcctcccccaagggcgcctcagtttccattaatgtcaacaccagccttgaagacatgaggagcaacaacgttgaggactgcaagatgatggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaaaaaaaaaaaaaaaaaaaaaaaaaaaaaaaaaaaaaaaaaaaaaaaaaaa

SEQ ID NO: 155 - DNA, 2645 bp, Homo sapiens
gagcgcagctggcctcacccggtcccggcgccgccttccggagcgtagcggcctctagctcgagcagcaggagcagcccgcaccggacaacttgcgagccatggggctggcggatgcgtcgggaccgagggacacacaggcactgctgtctgcaacacaagcaatggacctgcggaggcgagactaccacatggaacggccgctgctgaaccaggagcatttggaggagctggggcgctggggctcagcacctaggacccaccagtggcggacctggttgcagtgctcccgtgctcgggcctatgcccttctgctccaacacctcccggttttggtctggttaccccggtatcctgtgcgtgactggctcctgggtgacctgttatccggcctgagtgtggccatcatgcagcttccgcagggcttggcctacgccctcctggctggattgccccccgtgtttggcctctatagctccttctaccctgtcttcatctacttcctgtttggcacttcccggcacatctccgtggggacctttgctgtcatgtctgtgatggtgggcagtgtgacagaatccctggccccgcaggccttgaacgactccatgatcaatgagacagccagagatgctgcccgggtacaggtggcctccacactcagtgtcctggttggcctcttccaggtggggctgggcctgatccacttcggcttcgtggtcacctacctgtcagaacctcttgtccgaggctataccacagctgcagctgtgcaggtcttcgtctcacagctcaagtatgtgtttggcctccatctgagcagccactctgggccactgtccctcatctatacagtgctggaggtctgctggaagctgccccagagcaaggttggcaccgtggtcactgcagctgtggctggggtggtgctcgtggtggtgaagctgttgaatgacaagctgcagcagcagctgcccatgccgatacccggggagctgctcacgctcatcggggccacaggcatctcctatggcatgggtctaaagcacagatttgaggtagatgtcgtgggcaacatccctgcagggctggtgcccccagtggcccccaacacccagctgttctcaaagctcgtgggcagcgccttcaccatcgctgtggttgggtttgccattgccatctcactggggaagatcttcgccctgaggcacggctaccgggtggacagcaaccaggagctggtggccctgggcctcagtaaccttatcggaggcatcttccagtgcttccccgtgagttgctctatgtctcggagcctggtacaggagagcaccgggggcaactcgcaggttgctggagccatctcttcccttttcatcctcctcatcattgtcaaacttggggaactcttccatgacctgcccaaggcggtcctggcagccatcatcattgtgaacctgaagggcatgctgaggcagctcagcgacatgcgctccctctggaaggccaatcgggcggatctgcttatctggctggtgaccttcacggccaccatcttgctgaacctggaccttggcttggtggttgcggtcatcttctccctgctgctcgtggtggtccggacacagatgccccactactctgtcctggggcaggtgccagacacggatatttacagagatgtggcagagtactcagaggccaaggaagtccggggggtgaaggtcttccgctcctcggccaccgtgtactttgccaatgctgagttctacagtgatgcgctgaagcagaggtgtggtgtggatgtcgacttcctcatctcccagaagaagaaactgctcaagaagcaggagcagctgaagctgaagcaactgcagaaagaggagaagcttcggaaacaggcagggccccttttgtctgcatgtctggctccccagcaggtgagctcaggagataagatggaagatgcaacagccaatggtcaagaagactccaaggccccagatgggtccacactgaaggccctgggcctgcctcagccagacttccacagcctcatcctggacctgggtgccctctcctttgtggacactgtgtgcctcaagagcctgaagaatattttccatgacttccgggagattgaggtggaggtgtacatggcggcctgccacagccctgtggtcagccagcttgaggctgggcacttcttcgatgcatccatcaccaagaagcatctctttgcctctgtccatgatgctgtcacctttgccctccaacacccgaggcctgtccccgacagccctgtttcggtcaccagactctgaacatgctacatcctgcccaagactgcacctctggaggtgcagggcacccttgagaagcccctcacccctaggccgcctccaggtgctacccaggagtcccctccatgtacacacacacaactcagggaaggaggtcctgggactccaagttcagcgctccaggtctgggacagggcctgcatgcagtcaggctggcagtggcgcggtacagggagggaactggtgcatattttagcctcaggaataaagatttgtctgctcaaaaaaaaaaaaaaaaaaaaaaaaaaaaaaaaaaaaaaaaaaaaaaaaaaaaaaaaaaaaa

SEQ ID NO: 156 - DNA, 3105 bp, Homo sapiens
ccacctgccaggagcacgtcccgccggcagtcgcaggagccctgggagccgccgccatgggaatgtccaaatcacacagtttctttggttatcccctgagcatcttcttcatcgtggtcaatgagttttgcgaaagattttcctactatggaatgcgagcaatcctgattctgtacttcacaaatttcatcagctgggatgataacctgtccaccgccatctaccatacgtttgtggctctgtgctacctgacgccaattctcggagctcttatcgccgactcgtggctgggaaagttcaagaccattgtgtcgctctccattgtctacacaattggacaagcagtcacctcagtaagctccattaatgacctcacagaccacaaccatgatggcacccccgacagccttcctgtgcacgtggtgctgtccttgatcggcctggccctgatagctctcgggactggaggaatcaaaccctgtgtgtctgcgtttggtggagatcagtttgaagagggccaggagaaacaaagaaacagatttttttccatcttttacttggctattaatgctggaagtttgctttccacaatcatcacacccatgctcagagttcaacaatgtggaattcacagtaaacaagcttgttacccactggcctttggggttcctgctgctctcatggctgtagccctgattgtgtttgtccttggcagtgggatgtacaagaagttcaagccacagggcaacatcatgggtaaagtggccaagtgcatcggttttgccatcaaaaatagatttaggcatcggagtaaggcatttcccaagagggagcactggctggactgggctaaagagaaatacgatgagcggctcatctcccaaattaagatggttacgagggtgatgttcctgtatattccactcccaatgttctgggccttgtttgaccagcagggctccaggtggacactgcaggcaacaactatgtccgggaaaatcggagctcttgaaattcagcccgatcagatgcagaccgtgaacgccatcctgatcgtgatcatggtcccgatcttcgatgctgtgctgtaccctctcattgcaaaatgtggcttcaatttcacctccttgaagaagatggcagttggcatggtcctggcctccatggcctttgtggtggctgccatcgtgcaggtggaaatcgataaaactcttccagtcttccccaaaggaaacgaagtccaaattaaagttttgaatataggaaacaataccatgaatatatctcttcctggagagatggtgacacttggcccaatgtctcaaacaaatgcatttatgacttttgatgtaaacaaactgacaaggataaacatttcttctcctggatcaccagtcactgctgtaactgacgacttcaagcagggccaacgccacacgcttctagtgtgggcccccaatcactaccaggtggtaaaggatggtcttaaccagaagccagaaaaaggggaaaatggaatcagatttgtaaatacttttaacgagctcatcaccatcacaatgagtgggaaagtttatgcaaacatcagcagctacaatgccagcacataccagttttttccttctggcataaaaggcttcacaataagctcaacagagattccgccacaatgtcaacctaatttcaatactttctaccttgaatttggtagtgcttatacctatatagtccaaaggaagaatgacagctgccctgaagtgaaggtgtttgaagatatttcagccaacacagttaacatggctctgcaaatcccgcagtattttcttctcacctgtggcgaagtggtcttctctgtcacgggattggaattctcatattctcaggctccttccaacatgaagtcggtgcttcaggcaggatggctgctgaccgtggctgttggcaacatcattgtgctcatcgtggcaggggcaggccagttcagcaaacagtgggccgagtacattctatttgccgcgttgcttctggtcgtctgtgtaatttttgccatcatggctcggttctatacttacatcaacccagcggagatcgaagctcaatttgatgaggatgaaaagaaaaacagactggaaaagagtaacccatatttcatgtcaggggccaattcacagaaacagatgtgaaggtcaggaggcaagtggaggatggactgggcccgcagatgccctgacctctgcccccaggtagcaggacactccattggatggcccctgatgaggaagacttcagaattgggaactaaaccatgaatgctattttcttttttctttttcttttcttttttttttttttttttttgagacagagttttgctcttgttgtccaggctggagtgcaatggcacgatctcagctcactgcaacctccgcctcccaggttcaagtaattctcctgcctcagcctcccgagtggctgggattagcggcatgcaccaccacgcccagctatttttgtatttttagtagagatggggtttcaccatgttaaccaggatggtctcgatctcttgacctggtgatctgcccacctcggcctgccaaagtgctgggattacaggcttgagctaccgcgcccggccgtgaacgctattttctaagcagccagcagtgaatctaaaactctggaagaagtcttctgtttgaaaggcttatttaagccacacgtacacacactgtcttagagtactgtgagcccaccccacattggtcatcttccctatcacacaaatgatgttattttggactagcttaattttgaaatggtaacaaagtttcctattccatactgttcatttctaatactcttacgaaaactattctaaaggaggcaggagccaaggccaaaagtgaacgtacaggtttaaaatggctgtgataagggccagctggtattaactgataactttacctttgggtttttgttattttgtttttctagtccctacctgtgtttaaattatggataactcgaaagacaggctcaggtgaaggccgagtaatgattttttttgaagtttcaatggtgtgaaataaatttctgttctta

SEQ ID NO: 157 - DNA, 4413 bp, Homo sapiens
  misc_feature (3629)..(3629): n is a, c, g, or t
cgccctggctctcctcctcagaggctgtgggaggaggggcagatgataagagggggtgaagagggcatccccacagccccagctctccccacgtctcccatcaccccttcccaggcaccttgacagctgggactttgagttacgcactcccacctcttgttcctcaggttctgggggtatggggacagggagggggtacagcaagcagtgagaggcaacctgagtgagggtgtgtgtgagggctgcaggggcatttgagaatggaccacccatagcaatcatgccctctcttcctcccttgagcccagggcagacattactaatcaaccctagcattcctccaccaaagctagaggcagcacaggccagtcactaccaactctcactaccaacactcagaatgaagcagaatggacttgtgtgctcgtcaatgagtgcatgggagtgtaggtgagtgaagggggggcctgggggtgaggcggcccctaaagtgtgtaggcctcgaatgccaagcccaggagcagctgtctccccagaaggaagtggacagctatggagaccctgcacaggagggagcgtaatctgggtcttctagctgctgttcccaccctccaagccccgagtgtggtgtggctcacccaggtggctgggccctcccaggaggacttgctccgaggggctgctgtagggacccattcctgccttgctgacacatgccgtgcggaaggtgtaggtgccaccccgggagagcttgctggtcaggtagcagcagtcaaagatgtcggaggccagtgtggtccagctgccgcctggccacacaggagcacgtgaggggccactgaggcctccacacaccacgtcagtgggggtggagaaacccttccctgaggccacccatgggaacacagcaggccaggcatctccccaagggcccctagacatggctcccgggaggggtggccggagcctcgggtacaggggccacctcataccttctaggctgcactgcacaatgtaggtcacagggccgtaggattccacgggcttccagaccagcagcaccccatccgcgtacacctccccgatatccgggcatggcgaagatgaggggcgctctgcaaggcactgcccaatggtcagtgactccagggtgggcacccagcctccaggggccaatatctggctggcgcctgcctcaccctggcagccaccagggctctggagcccaccctccctggtcctgttcattcagggtccagtcacagtgaggaatggtaggaggggcctctcctggcgaggggctggggaggtgtctgccctgccagatcccactcctgggctggcccatccacctgggtgtgaccagaaccctgtgcaggggccgagcctctggtcagaagggcccttggtggggctgctgggcttcactgggttgccctgcacaggttcaagcaggccggcccactctgggcattgggccagggggtcccagagctaggcctgtagcccccatcctgaccacctcagaaacacgccccagggaactgtgttgtgcttgtaactcgactttgattgaggcatggaacgggaagcagcccactcctgcataggctggagggatgggcatggaaggaacgtgggaagatggtgcaatgggtcatgcgcccgagaaactcagttctcccggcaagtggccaatgggatgggctttctccctggcagggagcgtggatgaacaggcttccttccaagccctgtaacgtcagcagctgcgtccggccatccttcccaaggctggttgtttctgctgggaccagctcagggcctcctgccagcccaaggcagcctgggcggtcagaactctgtgttgaccttctcaggcctcctgcagccctggccatgtgtggtgcctggccccatagggatgtgggctgctcagggtcagggagcggatcctcagcggccaatgcacgggcccggaagcattccacgcaggatgaggcttcccagcagccccagcccagcctccctggcctggtgggacccccagtgtggcccacgtacctgccttccggagacgcccgtggtggtcactgtccccagcgcattgctcacgctgcaggtgtacacacccaggtcctcagccaccaccaccaggatggtcagaagctggaagttcttgagggtggcagagatgaggacacggctgctgctctccaggggggctccgtctgcaaaaggacagagcaagcctcatgccacagccaggcctcacacctctccctgggcctcagttttcctccagacagcgaggcatcccgtggggccagctcacaggatggccactcacccgatttcacacagcccccagcccctgggacagcttcttacctttgctccaggtggcctgggcagctggctgggctgacacctggcaggccagtgtcactgactggcccaggaccacagtctcatctgagagctcccttaggaatgtcggcgctgaggagggagggtgaggtcagccttcaggggtgacctccaggccccagagcatggcctggaccctggagacaccaggaggagccctgccccaccactgccaactccccagcctggcccatctgtaccaccatcacctcctccaggaagtcctccaagactgctcagttcactacacccaccaggacccctcatctgttcccgcacccatgtgagtgcaagcttgctccccaccggtctggccacgctggtgggaccctgagaggcagtggggcctggtctctgtgttgggcctgctcacctcggtcccagctcttcagacctgagagccggaaggaagcaaggcctggcttcttcctggggggcccctccttctccagacctgcaggaggaagagggccagtgaaggtcatggtcaggaggcctggcccctctgggtagtaccagctgcctctggctgcaaggaccccgagcagctgggacaggaagaaattggggtcggctggcccgctgcccactccccagacttccaggccacagaggacagaggaaacatgaagaccaggcaccctccccacctccaggcacggggtcaggagggtccagggccagggaggactatgtggttggggagaactatggggttgtgaacggtttgggggtctggaagggttttggggtcagggagggcctgaggtcaggagggtctggggtcaggtagggtatggagttggggagggtctggggtaaggtagggtctggggtcagagaggactatggggtcaaggaggactcaggaggatctggggttaggaaggtctgcagtcaggcaggatctggggttgggagagtgcagcgttggggtgtctggggtcagggagggcctggggccgttcgggaggactcggttcagggaggattatggttcaggaagactctggccccttcaaatgctttccccaggggcataccacctacagcctccccagacctccaccgctatgttaggtcccagggctgggtcccagctgccctgtggggagggttgtcagggctgtagaggtgatcccaagattcagaggcctgaggcagggacaggaggtgtgggcagcacctggacaccagcnggggggcccctgggagcctcctgccgtcacctggagtgcagtaaccttaggtacagaatgggggcccctggacatgcaggatgcttggggtggggtgggggttcacttccggcctgcccttcaggatccgggagatgtgctccacggaggccttcactctctcacgcagccccagctctgcaggctcatccagcggcaggtgcctcccagggaagtggaagaggctgcgtgacggcgaggaccacttgcgcttcctgcccactgcagcctctgccagcagcgcgtccacatcctctgactcctctgtgatctccaggcctgcgtgggggcccagttcacctggccagggccacgtgggctccgggaactcggccagctcctcctcagccatgggggagggcggctctggctgagcggacttggggactttcctgaagatcataaactcgaatgggaggtacttgatatcgtacaggtctgagaggttgaggtaggcggggtccacctcggaaatgtccagggatattgtgtcggccgcctccgcatcacctgacaggtcccggatctgcaccagggagacctgcccgatgtcctcccatggggtgggctctggagagctcctggtgggagccctgccgacctcaggcacaggccttgcactgacctggggcagtgggctctcagccctggcctcctgctgctcctccgactgggactcagccctggcctcctcctgctcctcctcctctgactgggacacagcccaggctatcctggcccacat

SEQ ID NO: 158 - DNA, 5746 bp, Homo sapiens
atggggttcctggagacccctccgcaggctgcagctatcccagacccctgggcctcaccccctctgcactcatttgccccttctacagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgcagccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggtaggcgcgcaggtccaagtgggtgagattctgggatggccccaggagctggggggcccacgggaggtgggtgcagtccacaccgtgcacttcccccacatcccccctagactggacacacagcaggtgtcggaagcactgctcagtgaagggtggggtgacggggtcccccagagtgggctgatagcagccctgccggtcctgtgcctccaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaaggttcgcatgtcctcacccctgcaccccagagcctggggcctgcaggccaggcctatcagccccaggagtcacccccttagggcacggctctcacccactcccaactctccccaacagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcagaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 159 - DNA, 25782 bp, Homo sapiens
ctgcgtgctgcccagagcccccatagagagaggtccccgccgccaccgtcatggatcagccacagttcagcggggcgccccgctttctcacccggcccaaggccttcgtggtgtcggtgggcaaggacgccaccctcagctgccagatcgtgggtaatcccacgccacaggtgagctgggagaaggaccagcagccggtggcggccggcgcgcgcttccgtctggcccaggacggcgacctctaccgcctcactatcctggacctggcgctgggcgacagtgggcaatacgtgtgccgcgcgcgcaatgccataggcgaggccttcgctgctgtgggcctgcaggtggacgcggaggccgcgtgcgccgagcaggcgccgcacttcctgctgcggcccacgtccatccgcgtgcgcgagggctcagaggccaccttccgctgccgcgtgggtggctccccgaggccggcagtgagctggtccaaggacgggcggcgcctgggtgagcccgacggcccccgcgtgcgcgtggaggagctcggcgaggcaagtgcgctgcgcattcgggcggcgcggccgcgcgacggcggcacttacgaggtccgcgccgagaacccgctgggcgctgccagcgccgccgcggcgctagtggtggactcggacgccgcggacacggccagccggcccgggacctccacggccgcgctcctggcgcacctgcagcggcggcgcgaggctatgcgcgccgagggcgcccccgcctcaccgcccagcaccggcacgcgcacctgcacggtgactgaaggcaagcacgcgcgcctcagctgctacgtgaccggcgagcccaagcccgagacggtgtggaagaaggacggccagctggtgaccgagggccggcgccacgtggtgtacgaggacgcgcaggagaacttcgtgctcaagatcctcttctgcaagcagtcggaccgcggcctctacacctgcacggcgtccaacctcgtgggccagacctacagctctgtgctggtcgtagtgcgcgagcccgcggttcccttcaaaaagcggctgcaagatctggaggtgcgggagaaggagtcggccacgttcctatgtgaggtgccccagccgtccactgaggccgcgtggttcaaggaggagacgcggttgtgggcgagcgccaagtacggcatcgaggaggagggcaccgagcgccgcctgaccgtgcgcaatgtctcggccgacgacgacgcggtgtacatctgcgagacgccagagggcagccgcacggtggcggagctcgcagtccaaggaaacctcctccgaaagctccctcggaagacggcggtgcgcgtgggcgacacggctatgttttgcgtggagctggcggtcccggtgggccccgtccactggctgcggaaccaggaggaagtggtggcggggggccgcgtggccatctccgcggagggcacgcgccacacactgaccatctcccagtgctgcctggaggatgtgggccaggtggcctttatggctggcgactgccagacgtccacccggttctgcgtgtcggcccccaggaagcctcccttgcaaccccctgtggatcctgtggtaaaggccaggatggagagttccgtgattctcagctggtccccaccaccccatggggaacgccctgtcactatcgacggctacctggtagagaagaagaagcttggcacctacacctggatcaggtgccacgaggctgaatgggtggctacacctgagctgaccgtggctgatgtggcggaggaggggaacttccagttccgagtgtccgctctcaacagctttggtcagagtccctacctcgagttcccggggactgtccacctggcccccaagctggccgtgaggacaccgctgaaggcggtgcaggcggtagagggtggcgaggtcactttctccgtggacctcacggtggcctcagcgggtgagtggttcctggatgggcaggccctgaaggccagcagtgtgtatgagatccactgtgatcgcacccggcacacgctcaccatccgggaggtgcccgccagcctgcacggggcgcagctgaagttcgtggccaacggcattgagagcagcatccggatggaggtccgggcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggcctcgcgcgctttctgcacaaggacatggcgggcagctgtgtggatgccgtggctgggggcccggcgcagtttgagtgtgagacctccgaagcccacgtccacgtgcactggtacaaggatggcatggagctgggccactccggtgagcgcttcttgcaggaggatgtggggacgcggcaccggctggtggcagccacagtcaccaggcaggatgaaggcacctactcctgccgcgtgggcgaggactctgtggacttccggctccgcgtctctgagcccaaggtggtgtttgctaaggagcagctggcacgcaggaagctgcaggcagaggcaggagccagtgccacactgagctgcgaggtggcccaggcccagacggaggtgacgtggtacaaggatgggaagaagctgagctccagctcgaaagtgtgcatggaggccacaggctgcacgcgcaggctggttgtgcagcaggcaggccaggcggatgccggggagtatagctgcgaggctgggggccagcggctctccttccatctggatgtcaaagagcccaaggtggtgtttgccaaggaccaggtggcacacagtgaggtgcaggctgaggcaggggccagtgccacgctgagctgcgaggtggcccaggcccagacggaggtgatgtggtacaaagatgggaagaagctgagctccagcttgaaagtgcatgtagaggccaagggctgcagacggaggctggtggtgcagcaggcaggcaagacggatgccggggactacagctgcgaggccaggggccagagggtctccttccgcctgcacatcacagagcccaagatgatgtttgcaaaggagcagtcagtgcataatgaggtgcaggctgaggcgggggccagtgccatgctgagctgtgaggtggcccaggcccagacggaggtgacgtggtacaaggatgggaagaagctgagctccagctcaaaagtgggcatggaggtcaaagggtgcacacggaggctggtgctgccacaggcgggcaaagcagatgctggggagtacagctgtgaggctgggggccagagagtctccttccacctgcacatcacagagcccaagggggtgtttgcgaaggagcagtcagtgcataatgaggtgcaggctgaggcggggaccactgccatgctgagctgtgaggtggcccagccccagacggaggtgacgtggtacaaggacgggaagaagctgagctccagctcaaaagtacgcatggaggtcaagggctgcacacgaaggctggtagtgcagcaggtgggcaaagcagatgctggggagtacagctgcgaggctgggggccagagagtctcctttcaactgcacatcacagagcccaaggcagtgtttgccaaggagcagttggtgcataatgaggtgcggactgaggcaggggccagtgccacactgagctgtgaggtggcccaggcccagacagaggtgacgtggtacaaggatgggaagaagctgagctccagttcgaaagtgcgcatagaggccgcgggctgcatgcggcagctggtggtgcagcaggcaggccaggcagatgctggggagtacacctgtgaggccgggggccagcggctctccttccacctggatgtttcagagcccaaggcggtgtttgcaaaggagcagctggcacacaggaaggtgcaggccgaggcgggggccattgccacgctgagctgcgaggtggcccaggcccagacagaggtgacgtggtacaaggacgggaagaagctgagctccagctcgaaagttcgaatggaggctgtgggctgcacacggaggctggtggtgcagcaggcatgccaggcggacaccggggagtatagctgcgaggccgggggccagcggctctccttcagcctggacgtggcagagcccaaggtggtgtttgccaaggagcagccagtgcacagggaggtgcaggcccaggcgggggccagcaccacactcagctgcgaggtggctcaggcccagacggaggtgatgtggtacaaggacgggaagaagctgagcttcagctcgaaagtgcgcatggaggctgtgggctgcacacggaggctggtggtgcagcaggcgggccaggcggacgccggggagtacagctgcgaggcggggagccagcggctctccttccacctgcacgtggcagagcccaaggtggtgtttgccaaggagcagccagcgagcagggaggtgcaggctgaggcggggaccagtgccacgctgagctgcgaggtggcccaggcccagacagaggtgacgtggtacaaggacgggaagaaactgagctccagctcgaaagtgcgaatggaggccgtgggctgcacacggaggctggtggtgcaggaggcaggccaggcggacgccggggagtacagctgcaaggccggggatcagcggctgtccttccacctgcacgtggcagagcccaaggtggtgtttgccaaggagcagccagcacacagggaggtgcaggctgaggcgggggccagtgccacgctgagctgcgaggtggcccaggcccagacagaggtgacgtggtacaaggatgggaagaagctgagttccagctcgaaagtgcgcgtggaggccgtgggctgcacacggaggctggtggtgcagcaggcgggccaggcagaggccggggagtacagctgcgaggcagggggtcagcagctctccttccgcctgcaggtggcagagctggagccccaaatttcagagagaccctgccgcagggagcctctggtggtcaaggagcatgaagacatcatcctgaccgccacactggccacaccctctgcggccacggtgacctggctcaaggatggtgtggagattcgccgcagcaagcggcatgagacagccagccagggggacacccacaccctgaccgtgcatggcgcccaggttctggacagcgccatctacagctgccgtgtgggcgcagaggggcaggacttcccagtgcaggtggaagaggtggccgccaagttctgccggctgctggagcctgtgtgcggcgagctgggtggcacggtgacactggcctgcgagctaagcccagcgtgtgcagaggtggtgtggcgctgcggcaacacgcagcttcgggtgggcaagcgcttccagatggtggccgaggggcccgtgcgctcactcactgtgttggggctgcgcgcagaggacgcaggggagtacgtgtgtgagagccgtgatgaccacaccagtgcgcagctcaccgtcagtgtgccccgagtggtgaagtttatgtctgggctgagcaccgtggtcgcagaggagggcggcgaggccaccttccagtgcgtggtgtcccccagtgatgtggcagtcgtgtggttccgggacggtgccctgcttcagcccagcgagaagtttgccatatcacagagtggcgccagccacagcctgaccatctcagacctggtgctggaggacgcgggccagatcaccgtggaggctgagggcgcctcatcctctgctgccctgagggtccgagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagatgcgccaggtacggctcgtacggggcctgcaggcagtggaggcacgggagcagggcacggctaccatggaggtgcagctgtcgcatgcggacgtggagggcagctggactcgtgacggtctgcggctccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccgagcttcccgtgagcttcagccgcccgctgcaggacgtggtgaccactgagaaggagaaggttaccctggagtgcgagctgtcgcgtcctaatgtggatgtgcgctggctgaaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggaaggacatacactctcatctaccggagagtcctggcggaagatgcaggagagatccaatttgtagccgaaaatgcagaatcgcgagcccagctccgagtgaaggagctgccagtgaccctcgtgcgcccgctgcgggacaagattgccatggagaagcaccgcggtgtgctggagtgtcaggtgtcccgggccagcgcccaggtgcggtggttcaagggcagtcaggagctgcagcccgggcccaagtacgagctggtcagtgatggcctctaccgcaagctgatcatcagtgatgtccacgcagaggacgaggacacctacacctgtgacgccggtgatgtcaagaccagtgcacagttcttcgtggaagagcaatccatcaccattgtgcggggtctgcaggacgtgacagtgatggagcccgctcctgcctggtttgagtgtgagacctccatcccctcagtgcggccacctaagtggctcctggggaagacggtgttgcaggctggggggaacgtgggcctggagcaggagggcacggtgcaccggctgatgctgcggcggacctgctccaccatgaccgggcccgtgcacttcaccgttggcaagtcgcgctcctctgcccgcctggtggtctcagacatccccgtagtcctcacacggccgttggagcccaagacagggcgtgagctgcagtcagtggtcctgtcctgcgacttccggccagcccccaaggctgtgcagtggtacaaggatgacacgcccctgtctccctctgagaagtttaagatgagcctggagggtcagatggctgagctgcgcatcctccggctcatgcctgctgatgctggtgtctaccggtgccaggcgggcagtgcccacagcagcactgaggtcactgtggaagcgcgggaggtgacagtgacagggccgctacaggatgcagaggccacggaggagggctgggccagcttctcctgtgagctgtcccacgaggatgaggaggtcgagtggtcgctcaacgggatgcccctgtacaacgacagcttccatgagatctcacacaagggccggcgccacacgctggtactgaagagcatccagcgggctgatgcgggcatagtacgcgcctcctccctgaaggtgtcgacctctgcccgcctggaggtccgagtgaagccggtggtgttcctgaaggcgctggatgacctgtccgcagaggagcgcggcaccctggccctgcagtgtgaagtctctgaccccgaggcccatgtggtgtggcgcaaagatggcgtgcagctgggccccagtgacaagtatgacttcctgcacacggcgggcacgcgggggctcgtggtgcatgacgtgagccctgaagacgccggcctgtacacctgccacatgggctccgaggagacccgggcccgggtccgcgtgcacgatctgcacgtgggcatcaccaagaggctgaagacaatggaggtgctggaaggggaaagctgcagctttgagtgcgtcctgtcccacgagagtgccagcgacccggccatgtggacagtcggtgggaagacagtgggcagctccagccgcttccaggccacacgtcagggccgaaaatacatcctggtggtccgggaggctgcaccaagtgatgccggggaggtggtcttctctgtgcggggcctcacctccaaggcctcactcattgtcagagagaggccggccgccatcatcaagcccctggaagaccagtgggtggcgccaggggaggacgtggagctgcgctgtgagctgtcacgggcgggaacgcccgtgcactggctgaaggacaggaaggccatccgcaagagccagaagtatgatgtggtctgcgagggcacgatggccatgctggtcatccgcggggcctcgctcaaggacgcgggcgagtacacgtgtgaggtggaggcttccaagagcacagccagcctccatgtggaagaaaaagcaaactgcttcacagaggagctgaccaatctgcaggtggaggagaaaggcacagctgtgttcacgtgcaagacggagcaccccgcggccacagtgacctggcgcaagggcctcttggagctacgggcctcagggaagcaccagcccagccaggagggcctgaccctgcggctcaccatcagtgccctggagaaggcagacagcgacacctatacctgcgacattggccaggcccagtcccgggcccagctcctagtgcaaggccggagagtgcacatcatcgaggacctggaggatgtggatgtgcaggagggctcctcggccaccttccgttgccggatctccccggccaactacgagcctgtgcactggttcctggacaagacacccctgcatgccaacgagctcaatgagatcgatgcccagcccgggggctaccacgtgctgaccctgcggcagctggcgctcaaggactcgggcaccatctactttgaggcgggtgaccagcgggcctcggccgccctgcgggtcactgagaagccaagcgtcttctcccgggagctcacagatgccaccatcacagagggtgaggacttgaccctggtgtgcgagaccagcacctgcgacattcctgtgtgctggaccaaggatgggaagaccctgcgggggtctgcccggtgccagctgagccatgagggccaccgggcccagctgctcatcactggggccaccctgcaggacagtggacgctacaagtgtgaggctgggggcgcctgcagcagctccattgtcagggtgcatgcgcggccagtgcggttccaggaggccctgaaggacctggaggtgctggagggtggtgctgccacactgcgctgtgtgctgtcatctgtggctgcgcccgtgaagtggtgctatggaaacaacgtcctgaggccaggtgacaaatacagcctacgccaggagggtgccatgctggagctggtggtccggaacctccggccgcaggacagcgggcggtactcatgctccttcggggaccagactacttctgccaccctcacagtgactgccctgcctgcccagttcatcgggaaactgagaaacaaggaggccacagaaggggccacggccacgctgcggtgtgagctgagcaagacagcccctgtggagtggagaaaggggtccgagaccctcagagatggggacagatactgtctgaggcaggacggggccatgtgtgagctgcagatccgtggcctggccatggtggatgccgcggagtactcgtgtgtgtgtggagaggagaggacctcagcctcactcaccatcaggcccatgcctgcccacttcataggaagactgagacaccaagagagcatagaaggggccacagccacgctgcggtgtgagctgagcaaggcggcccccgtggagtggaggaaggggcgtgagagcctcagagatggggacagacatagcctgaggcaggacggggctgtgtgcgagctgcagatctgtggcctggctgtggcagatgctggggagtactcctgtgtgtgtggggaggagaggacctctgccactctcaccgtgaaggccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcagggctctgcctgccaggttcatagaagatgtgaaaaaccaggaggccagagaaggggccacggctgtgctgcagtgtgagctgaacagtgcagcccctgtggagtggagaaaggggtctgagacccttagagatggggacagatacagcctgaggcaggacgggactaaatgtgagctgcagattcgtggcctggccatggcagacactggggagtactcgtgcgtgtgcgggcaggagaggacctcggctatgctcaccgtcagggctctacccatcaagttcacagagggtctgaggaacgaagaggccacagaaggggcaacagccgtgctgcggtgtgagctgagcaagatggcccccgtggagtggtggaaggggcatgagaccctcagagatggagacagacacagcctgaggcaggacggggccaggtgtgagctgcagatccgcggcctcgtggcagaggacgctggggagtacctgtgcatgtgcgggaaggagaggacctcagccatgctcaccgtcagggccatgccttccaagttcatagagggtctgaggaatgaagaggccacagaaggggacacggccacgctgtggtgtgagctgagcaaggcggcaccggtggagtggaggaaggggcatgagaccctcagagatggggacagacacagcctgaggcaggatgggtccaggtgtgagctgcagatccgtggcctggctgtggtggatgccggggagtactcgtgtgtgtgcgggcaggagaggacctcagccacactcactgtcagggccctgcctgccagattcatagaagatgtgaaaaaccaggaggccagagaaggggccacggccgtgctgcaatgtgagctgagcaaggcggcccccgtggagtggaggaaggggtctgagaccctcagaggtggggacagatacagcctgaggcaggatgggaccagatgtgagctgcagattcatggcctgtctgtggcagacactggggagtactcgtgtgtgtgcgggcaggagaggacctcggccacactcaccgtcagggccctgcctgcacgattcactcaagatctgaagaccaaggaggcctcagaaggggccacagctacactgcagtgtgagctgagcaaggtggcccctgtggaatggaagaagggtcctgagaccctcagagatgggggcagatacagcctgaagcaggatgggacgaggtgtgagctgcagatccatgacctgtctgtggcggatgctggggaatactcatgcatgtgtggacaagagaggacctcggccacgctcactgtcagggccctgcctgccaggttcacagagggtctgaggaatgaagaggccatggaaggggccacagccacactgcaatgtgagctgagcaaggcagcccctgtggagtggaggaaaggccttgaggctctcagagatggggacaaatacagcctgagacaagacggggctgtgtgtgagctgcagattcatggcctggctatggcagataacggggtgtactcatgtgtgtgtgggcaggagaggacctcagctacactcactgtcagggccctgcctgccagattcatagaggatatgagaaaccagaaggccacagaaggggctacagtcacattgcaatgtaagctgagaaaggcggcccccgtggagtggagaaaggggcccaacaccctcaaagatggggacaggtacagcctgaagcaggatgggaccagttgtgagctgcagattcgtggcctggtcatagcagatgctggagaatactcgtgcatatgtgagcaggagaggacctcggccacgctcactgtcagggccctgccggccagattcatagaagatgtgagaaatcacgaggccacagaaggggccacagctgtgctgcagtgtgagctgagcaaggcggcccccgtggagtggcggaaggggtctgagaccctcagagatggggacagatatagcctgaggcaggacgggacgaggtgtgagctgcagattcgtggcctggctgtggaggacactggagagtatttgtgtgtgtgcgggcaggagagaacctcagctacactcactgtcagggccctgccagccagattcatagacaacatgacaaaccaggaagccagagaaggggccacggccacactgcactgtgaactgagcaaggtggcccctgtggagtggaggaagggacctgaaaccctccgagatggggacagacacagcctgaggcaggatgggaccaggtgtgagctgcagattcgtggcctgtctgtggcagatgccggggagtactcgtgcgtgtgtgggcaggagaggacctcagccacactcacgatcagggccctgcccgccaagttcacaaagggtctgaggaatgaagaggccacagaaggggccacggctatgttgcagtgtgagctgagcaaggtggcccctgttgagtggaggaagggacctgaaaccctcagagatggggacagatacaacctgaggcaggatgggaccagatgtgagctgcagattcatggcctgtccgtggcagacactggggagtactcatgtgtatgtggtcaggagaagacgtcggccactctcactgtcaaggccccacagccagtgttccgggagccgctgcagagtctgcaggcggaggagggctccacggccaccctgcagtgtgagctgtctgagcccactgctacagtggtctggagcaagggtggcctgcagctgcaggccaatgggcgccgggagccacggcttcagggctgcaccgcggagctggtgttacaggacctacaacgtgaagacactggcgaatacacttgcacctgtggctcccaggccaccagtgccaccctcactgtcacagctgcgcctgtgcggttcctccgagagctgcagcaccaggaggtggatgagggaggcaccgcacacttatgctgcgagctgagccgggcgggtgcgagcgtggagtggcgcaagggctccctacagctcttcccttgtgccaagtaccagatggtgcaggatggtgcagctgcagagctgctggtacgcagagtggagcaggaggatgcgggtgactacacgtgtgacacgggccacacgcagagcatggccagcctctctgtccgtgtccccaggcccaagttcaagacccggcttcagagtctggagcaggagacaggtgacatagcccggctgtgctgtcagctgagtgatgcagagtcgggggccgtggtgcaatggctcaaggagggcgtggagctgcatgcgggccccaagtacgagatgcggagccagggggccacgcgggagctgctgatccaccaactggaggccaaggacacgggcgagtatgcctgtgtgacaggcggccagaaaaccgctgcctccctcagggtcacagagcctgaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgaggacgctggcactgtctccttccatttgggaaaccatgcttcctctgcccagctcaccgtcagagctcctgaggtgaccatcctggagcccctgcaggacgtgcagctcagtgagggccaggatgccagcttccagtgccggctatccagagcttcaggccaggaggcccgctgggctttaggaggggtgcccctgcaggccaacgagatgaatgacatcactgtggagcagggcacactccacctgctcaccctgcacaaggtgacccttgaggatgctggaactgtcagtttccacgtgggcacgtgtagctctgaggcccagctgaaagtcacagccaagaacacggtggtgcgggggctggagaatgtggaggcgctggagggcggcgaggcgctgttcgagtgccagctgtcccagcccgaggtggccgcccacacctggctgctggacgacgaacccgtgcgcacctcggagaacgccgaggtggtcttcttcgagaacggcctgcgccacctgctgctgctcaaaaacttgcggccacaagacagctgccgggtgaccttcctggctggggatatggtgacgtccgcattcctcacggtccgaggctggcgcctggagatcctggagcctctgaaaaacgcggcggtccgggccggcgcacaggcacgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgtggctcaccgtgctgggcctccctgatcccccagaggatgctgaggtggtggctcgcagcagccacactgtgacactgtcttgggcagctcccatgagtgatggaggcggtggtctctgtggctaccgcgtggaggtgaaggagggggccacaggccagtggcggctgtgccacgagctggtgcctggacccgagtgtgtggtggatggcctggcccccggggagacctaccgcttccgtgtggcagctgtgggccctgtgggtgctggggaaccggttcacctgccccagacagtgcggcttgcagagccaccgaagcctgtgcctccccagccctcagcccctgagagccggcaggtggcagctggtgaagatgtctgtctggagcttgaggtggtggctgaggctggcgaggtcatctggcacaagggaatggagcgcatccagcccggtgggcggttcgaggtggtctcccagggtcggcaacagatgctggtgatcaagggcttcacggcagaagaccagggcgagtaccactgtggcctggctcagggctccatctgccctgcggctgccaccttccaggtggcactgagcccagcctctgtggatgaggcccctcagcccagcttgccccccgaggcagcccaggagggtgacctgcacctactgtgggaggccctggctcggaaacgtcgcatgagccgtgagcccacgctggactccattagcgagctgccagaggaggacggccgctcgcagcgcctgccacaggaggcagaggaggtggcacctgatctctctgaaggctactccacggccgatgagctggcccgcactggagatgctgacctctcacacaccagctctgatgatgagtcccgggcaggcaccccttccctggtcacctacctcaagaaggctgggaggccaggcacctcaccactggccagcaaggttggggccccagcagccccctctgtgaagccacagcagcagcaggagccactggctgctgtgcgcccaccactgggagacctgagcaccaaagacctgggtgatccctcaatggacaaggcagctgtgaagatccaggctgcctttaagggctacaaggtccggaaggagatgaagcagcaggaagggcccatgttctcccacacatttggggacaccgaggcacaggtgggggatgccctgcggctggagtgtgtcgtggccagcaaggcagatgtgcgagcccgctggctgaaggatggtgtggagctgaccgatgggcggcaccatcacatcgaccagcttggggatggcacctgctctctgctgatcactggcctgggccgtgctgatgctggctgctacacctgtcaggtgagcaacaagtttggccaggtgacccacagtgcctgtgtggtggtcagtgggtcagagagtgaagccgagagctcctctgggggtgagctggacgatgccttccgccgggctgcccgtcggctgcaccggctcttccgcaccaaaagtccggctgaagtttcagatgaggagctcttcctgagtgcagacgagggccctgcagagccagaggagcccgcggactggcagacataccgcgaagatgagcatttcatctgcatccgttttgaggcgctcactgaggcccgccaggcggtaactcgcttccaggagatgtttgccacactgggcattggggtggagatcaagctggtggaacaggggcctcggagggtagagatgtgcatcagcaaagagactcctgcccctgtggtgcctccagagccattgcccagcctactgacttctgacgctgccccagtgttcctgactgagttgcagaaccaagaagtgcaggatgggtatcctgtgagctttgactgcgtggtgacaggtcagcccatgcccagtgtgcgctggttcaaggatgggaagttgttggaggaggatgatcactacatgattaatgaagaccaacagggtggccatcagctcatcatcacagccgtggtgccagcagacatgggcgtctaccgctgcctggccgagaacagcatgggtgtctcctccaccaaggctgagctccgtgtggacttgacaagcacagactatgacactgcagcagatgccacggagtcctcatcctacttcagtgcccaaggctacctgtccagccgggagcaggagggaacagagtccaccactgatgagggccagctgccccaggtggtggaggagctgagagacgtccaggtggcccctggcacacgcctggccaagttccagctcaaggtgaaaggctaccctgctcccagattatactggttcaaagatggccagcccctgaccgcatctgcccacatccgcatgactgacaagaagatcctgcacaccctggagatcatctccgtcacccgggaggactctggccagtatgcagcctatatcagcaatgccatgggtgctgcctactcgtctgcccggctgctggttcgaggccctgatgagccagaagagaagcctgcatcagatgtgcatgagcagctggtgccgccccgaatgctggagaggttcacccccaagaaagtgaagaaaggctccagcatcaccttctctgtgaaggtagaaggacgcccggtgcccaccgtgcactggctcagggaggaggctgagagaggcgtgctgtggattggccctgacacaccgggctacaccgtggccagctctgcgcagcagcacagcctggtcctgctggacgtgggccggcagcaccagggcacctacacatgcattgccagcaacgctgccggccaggccctctgctccgccagcctgcacgtctcgggcctgcctaaggtggaggagcaggagaaagtgaaggaagcgctgatttccactttcctgcaggggaccacacaagccatctcagcacaggggttggaaactgcgagttttgctgaccttggtgggcagaggaaagaagagcctctggctgccaaggaggccctcggccacctgtccctcgctgaggtgggcacagaggagttcctgcagaaactgacctcccagatcactgagatggtatcggccaagatcacgcaggccaagctgcaggtgcccggaggtgacagtgatgaggactccaagacaccatctgcatccccccgccatggccgatcacggccatcctccagcatccaggagtcttcctcagagtcagaggacggcgatgcccgaggcgagatctttgacatctacgtggtcaccgctgactacctgcccctaggggctgagcaggatgccatcacgctgcgggaaggccagtatgtggaggtcctggatgcagcccacccactgcgctggcttgtccgcaccaagcccaccaagtccagcccctcacggcagggctgggtgtcaccagcctacctggacaggaggctcaagctgtcacctgagtggggggccgctgaggcccctgagttccctggggaggctgtgtctgaagacgaatacaaggcaaggctgagctctgtgatccaggagctgctgagttctgagcaggccttcgtggaggagctgcagttcctgcagagccaccacctgcagcacctggagcgctgcccccacgtgcccatagctgtggccggccagaaggcagtcatcttccgcaatgtgcgggacatcggccgcttccacagcagcttcctgcaggagttgcagcagtgcgacacggacgacgacgtggccatgtgcttcatcaagaaccaggcggcctttgagcagtacctggagttcctggtggggcgtgtgcaggctgagtcggtggtcgtcagcacggccatccaggagttctacaagaaatacgcggaggaggccctgttggcaggggacccctctcagcccccgccaccacctctgcagcactacctggagcagccagtggagcgggtgcagcgctaccaggccttgctgaaggagctgatccgcaacaaggcgcggaacagacagaactgcgcgctgctggagcaggcctatgccgtggtgtctgccctgccacagcgcgctgagaacaagctgcacgtgtccctcatggagaactacccaggcaccctggaggccctgggcgagcccatccgccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcggcccccggactttgaagaggagctggccgactgcacagccgagctgggtgagacagtcaagctggcctgccgcgtgacgggcacacccaagcctgtcatcagctggtacaaagatgggaaagcagtgcaggtggacccccaccacatcctcattgaagaccctgatggctcgtgtgcactcatcctggacagcctgaccggtgtggactctggccagtacatgtgcttcgcggccagcgccgctggcaactgcagtaccctgggcaagatcctggtgcaagtcccaccacggttcgtgaacaaggtccgggcctcaccctttgtggagggagaggacgcccagttcacctgcaccatcgaaggcgccccgtacccgcagatcaggtggtacaaggacggggccctgctgaccactggcaacaagttccagacactgagtgagcctcgcagcggcctgctagtgctggtgatccgggcggccagcaaggaggacctggggctctacgagtgtgagctggtgaaccggctgggctccgcgcgggctagtgcggagctgcgcattcagagccccatgctgcaggcccaggagcagtgtcacagggagcagctcgtggctgcagtggaagacaccaccctggagcgagcggaccaggaggtcacatctgtcctgaagagactgctgggccccaaggcgccaggcccctccacaggggacctcactggccctggcccctgccccaggggggcacccgcactccaggaaaccggctcccagcccccagtcaccggaacttcggaggcacctgccgtgcccccgagggtgccacagcccctcctccacgaaggcccagagcaggagccggaggccattgccagagcccaggaatggactgtgcccattcggatggagggtgcagcctggcccggggcaggcacaggggagctgctctgggacgtccacagccacgtggtcagagagaccacacagaggacctacacataccaggccatcgacacgcacaccgcacggcccccatccatgcaggtaaccatcgaggatgtgcaggcacagacaggcggaacggcccaattcgaggctatcattgagggcgacccacagccctcggtgacctggtacaaggacagcgtccagctggtggacagcacccggcttagccagcagcaagaaggcaccacatactccctggtgctgaggcatgtggcctcgaaggatgccggcgtttacacctgcctggcccaaaacactggtggccaggtgctctgcaaggcagagctgctggtgcttgggggggacaatgagccggactcagagaagcaaagccaccggaggaagctgcactccttctatgaggtcaaggaggagattggaaggggcgtgtttggcttcgtaaaaagagtgcagcacaaaggaaacaagatcttgtgcgctgccaagttcatccccctacggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgaggtcaaggtctacatccagcagctggtggaggggctgcactacctgcacagccatggcgttctccacctggacataaagccctctaacatcctgatggtgcatcctgcccgggaagacattaaaatctgcgactttggctttgcccagaacatcaccccagcagagctgcagttcagccagtacggctcccctgagttcgtctcccccgagatcatccagcagaaccctgtgagcgaagcctccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcggaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggacgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgag

SEQ ID NO: 160 - DNA, 2344 bp, Homo sapiens
cgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggaatactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatggaaaaaaaaaaaaaaa

SEQ ID NO: 161 - DNA, 3516 bp, Homo sapiens
aagagcccgcggtggcgctgccaggggatgctagcccgagagcgagcagaggagcagcgcacccgcacgagccttggaccctttggaaccgaaagcacgcccgtcctcagagtcccgtcctcaaagtcccatcctcgccatggcacccggagagaagatcaaagccaaaatcaagaagaatctgcccgtgacgggccctcaggcgccgaccattaaagagctgatgcggtggtactgcctcaacaccaacacccatggctgtcgccgcatcgtggtgtcccgcggccgtctgcgccgcctcctctggatcgggttcacactgactgccgtggccctcatcctctggcagtgcgccctcctcgtcttctccttctatactgtctcagtttccatcaaagtccacttccggaagctggattttcctgcagtcaccatctgcaacatcaacccctacaagtacagcaccgttcgccaccttctagctgacttggaacaggagaccagagaggccctgaagtccctgtatggctttccagagtcccggaagcgccgagaggcggagtcctggaactccgtctcagagggaaagcagcctagattctcccaccggattccgctgctgatctttgatcaggatgagaagggcaaggccagggacttcttcacagggaggaagcggaaagtcggcggtagcatcattcacaaggcttcaaatgtcatgcacatcgagtccaagcaagtggtgggattccaactgtgctcaaatgacacctccgactgtgccacctacaccttcagctcgggaatcaatgccattcaggagtggtataagctacactacatgaacatcatggcacaggtgcctctggagaagaaaatcaacatgagctattctgctgaggagctgctggtgacctgcttctttgatggagtgtcctgtgatgccaggaatttcacgcttttccaccacccgatgcatgggaattgctatactttcaacaacagagaaaatgagaccattctcagcacctccatggggggcagcgaatatgggctgcaagtcattttgtacataaacgaagaggaatacaacccattcctcgtgtcctccactggagctaaggtgatcatccatcggcaggatgagtatcccttcgtcgaagatgtgggaacagagattgagacagcaatggtcacctctataggaatgcacctgacagagtccttcaagctgagtgagccctacagtcagtgcacggaggacgggagtgacgtgccaatcaggaacatctacaacgctgcctactcgctccagatctgccttcattcatgcttccagacaaagatggtggagaaatgtgggtgtgcccagtacagccagcctctacctcctgcagccaactactgcaactaccagcagcaccccaactggatgtattgttactaccaactgcatcgagcctttgtccaggaagagctgggctgccagtctgtgtgcaaggaagcctgcagctttaaagagtggacactaaccacaagcctggcacaatggccatctgtggtttcggagaagtggttgctgcctgttctcacttgggaccaaggccggcaagtaaacaaaaagctcaacaagacagacttggccaaactcttgatattctacaaagacctgaaccagagatccatcatggagagcccagccaacagtattgagatgcttctgtccaacttcggtggccagctgggcctgtggatgagctgctctgttgtctgcgtcatcgagatcatcgaggtcttcttcattgacttcttctctatcattgcccgccgccagtggcagaaagccaaggagtggtgggcctggaaacaggctcccccatgtccagaagctccccgtagcccacagggccaggacaatccagccctggatatagacgatgacctacccactttcaactctgctttgcacctgcctccagccctaggaacccaagtgcccggcacaccgccccccaaatacaataccttgcgcttggagagggccttttccaaccagctcacagatacccagatgctggatgagctctgaggcagggttgagaagacagatctagtcaggaccaccagccatggtctaaggacatggatcgggtgcccccagacgtgtgcacaggggaccctctgccccactctgggcttttcagatactctgaccaaaaagcctgctttaaaccgcaagatggggcctgggcatgcgcaggaggagccatcgggtactacgcagcaacactcacaactgtccaggctgagataaatcccgggacctgaactattagcacgtcactagagactgggagccgaggcagtggtgctggcccaagtgaaggccagagtgaggactgatgcagctctctacgggtcttgagagggaaggactcttccaaagccccaaagccgagggtttcacccacactgccagcctgggttggggcccaaggatgtgaccttgagtgtcaaggctggacagctactgccagatgccaaagataggagaaagtgccagccctgaagctggagccgtttgtgaataaactgttcttcatcattgacactggagaaaggtgtcctccatgccctcaggcagcagagaactggcccagggcccttggagtgttggtggagatcagagtgccgtggtggaggtctgggactatgtcagagtgtcctcactttggggcatgggtgggcccaggagatggatttagttattcaattttgtggatgaataaattgaggcacagaaagattaagttaccggcccaaggtgacacagtgaggaggtggcagagctaggatttgaacccagacaatctgactccatgattttgcatccaattcgtgtctgtgccttttaaagggtgaggtctgtgtcactttgggtggggagggggagcatggtgggccatgctctgggcagctgttccaagacagagctgacccttccattaccaatggcctgtccctcaccaacaagccaactgccacagatgacccacttcataccacattcacatctttccacctgaaatggctaacaggtattaaatccttggttggtgtttaaagccaacccaagaacagggtgttaggtactgttttaagcacctagataggttagcataggggactgcaaatggtgttccgcaaagcaaatcctgtttttgaccatgaactaagaattttattttattttattttttattttttgtagaaataggatctcactatgttgcccaggctgttcttgaactcctggcctcaaatgatcttcccacttcagcctcccaaagtgcagggattacaggcacaagccaccgtgcccagccaagaatttttatttttgcttttaaatagcaaaagaagaagattctgtgactcatgaaaatgatatgagattcgaattccagtgtctataaataaagttttattggtacacagcaaaaaaaaaaaaaaaaa

SEQ ID NO: 162 - DNA, 2022 bp, Homo sapiens
caatcatggatcaatagctatgtttggagaaggaatttgtggctgctccagctactgggcattttgtctggtccagttcatgtaatctcccaacaccccatgaagcaaggctttgttaatcctattttactgaaaatgaactaagactcagagagataaagctgttgcccaatgagccttctttctgccctccagatccacggtgctaattccccttccgatgacctaatgattctgagcttggcaaaggtcttatctcccagctcgcccaggcccagtgttccaggaatgtgacctttgctgcagcagccgctggagggggcagaggggatgggctggaggttgagcaaacagagcagcagaaaaggcagttcctcttctccagtgccctccttccctgtctctgcctctccctcccttcctcaggcatcagagcggagacttcagggagaccagagcccagcttgccaggcactgagctagaagccctgccatggcacccctgagaccccttctcatactggccctgctggcatgggttgctctggctgaccaagagtcatgcaagggccgctgcactgagggcttcaacgtggacaagaagtgccagtgtgacgagctctgctcttactaccagagctgctgcacagactatacggctgagtgcaagccccaagtgactcgcggggatgtgttcactatgccggaggatgagtacacggtctatgacgatggcgaggagaaaaacaatgccactgtccatgaacaggtggggggcccctccctgacctctgacctccaggcccagtccaaagggaatcctgagcagacacctgttctgaaacctgaggaagaggcccctgcgcctgaggtgggcgcctctaagcctgaggggatagactcaaggcctgagacccttcatccagggagacctcagcccccagcagaggaggagctgtgcagtgggaagcccttcgacgccttcaccgacctcaagaacggttccctctttgccttccgagggcagtactgctatgaactggacgaaaaggcagtgaggcctgggtaccccaagctcatccgagatgtctggggcatcgagggccccatcgatgccgccttcacccgcatcaactgtcaggggaagacctacctcttcaagggtagtcagtactggcgctttgaggatggtgtcctggaccctgattacccccgaaatatctctgacggcttcgatggcatcccggacaacgtggatgcagccttggccctccctgcccatagctacagtggccgggagcgggtctacttcttcaaggggaaacagtactgggagtaccagttccagcaccagcccagtcaggaggagtgtgaaggcagctccctgtcggctgtgtttgaacactttgccatgatgcagcgggacagctgggaggacatcttcgagcttctcttctggggcagaacctctgctggtaccagacagccccagttcattagccgggactggcacggtgtgccagggcaagtggacgcagccatggctggccgcatctacatctcaggcatggcaccccgcccctccttggccaagaaacaaaggtttaggcatcgcaaccgcaaaggctaccgttcacaacgaggccacagccgtggccgcaaccagaactcccgccggccatcccgcgccatgtggctgtccttgttctccagtgaggagagcaacttgggagccaacaactatgatgactacaggatggactggcttgtgcctgccacctgtgaacccatccagagtgtcttcttcttctctggagacaagtactaccgagtcaatcttcgcacacggcgagtggacactgtggaccctccctacccacgctccatcgctcagtactggctgggctgcccagctcctggccatctgtaggagtcagagcccacatggccgggccctctgtagctccctcctcccatctccttcccccagcccaataaaggtcccttagccccgagtttaaa

SEQ ID NO: 163 - DNA, 690 bp, Homo sapiens
gctcatgaagttcaaattgagattgttgccactgtggtttgccacactgacacctataccctgagcagagctggtcctgagggttgttttccggtgatcttgggacatgaaggtgctggaattgtgaaaagtgttggtgagggagttactaagctgaaggcggaagataaagtcacacaagggaaaggattaatgccagatggtaccagcagatttacttgcaaaggaaagataattttacattacatgggaatcagcacattttctgaatacacagttgtggctgatatctctgtttccaaaatagatcctttagcacgtttggataaagttggccttctaggttgtggcatttcaactggttatggtcctgctgtgaacactgccaagctggagcctggctctgtttgtgccatctttggcctgggaggatttggatcgggggttaccatgggctgtaaagtgactggtgcatcccagatcattggtgtggacatcaataaagataaattttcaagggccaaagaacttggagccgctgaatgcattagtcctcaggattttagtaaacccacccaggaagtgctcattgagataatgagcactgatggaggagtggactattcctttgaatgtactggtaatgtgaaggtcatgagagcagcacttgaggcatgtcaccagggctag

SEQ ID NO: 164 - DNA, 3851 bp, Homo sapiens
agactggggtgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggacgtcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcctacaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggccatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttctgtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggcagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcctgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggctcatagagggccaggaagtaaaatgctcagcgttcatgttgttgggtatgggaagtatgaactggaagaggatggatccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaaaaaaaaaaaaaaaaaaaaaaaaaaaaaaaa

SEQ ID NO: 165 - DNA, 2053 bp, Homo sapiens
cagggctgaagttgggaccgcgcacagaccgcccctgcagtccagcccgaaatgctgccgccaggcagcaacggcaccgcgtacccggggcagttcgctctataccagcagctggcgcaggggaacgccgtggggggctcggcgggggcaccgccactggggccctcacaggtggtcaccgcctgcctgctgaccctactcatcatctggaccctgctgggcaacgtgctggtgtgcgcagccatcgtgcggagccgccacctgcgcgccaacatgaccaacgtcttcatcgtgtctctggccgtgtcagaccttttcgtggcgctgctggtcatgccctggaaggcagtcgccgaggtggccggttactggccctttggagcgttctgcgacgtctgggtggccttcgacatcatgtgctccactgcctccatcctgaacctgtgcgtcatcagcgtggaccgctactgggccatctccaggcccttccgctacaagcgcaagatgactcagcgcatggccttggtcatggtcggcctggcatggaccttgtccatcctcatctccttcattccggtccagctcaactggcacagggaccaggcggcctcttggggcgggctggacctgccaaacaacctggccaactggacgccctgggaggaggacttttgggagcccgacgtgaatgcagagaactgtgactccagcctgaatcgaacctacgccatctcttcctcgctcatcagcttctacatccccgttgccatcatgatcgtgacctacacgcgcatctaccgcatcgcccaggtgcagatccgcaggatttcctccctggagagggccgcagagcacgcgcagagctgccggagcagcgcagcctgcgcgcccgacaccagcctgcgcgcttccatcaagaaggagaccaaggttctcaagaccctgtcggtgatcatgggggtcttcgtgtgttgctggctgcccttcttcatccttaactgcatggtccctttctgcagtggacaccctgaaggccctccggccggcttcccctgcgtcagtgagaccaccttcgacgtcttcgtctggttcggctgggctaactcctcactcaaccccgtcatctatgccttcaacgccgactttcagaaggtgtttgcccagctgctggggtgcagccacttctgctcccgcacgccggtggagacggtgaacatcagcaatgagctcatctcctacaaccaagacatcgtcttccacaaggaaatcgcagctgcctacatccacatgatgcccaacgccgttacccccggcaaccgggaggtggacaacgacgaggaggagggtcctttcgatcgcatgttccagatctatcagacgtccccagatggtgaccctgttgctgagtctgtctgggagctggactgcgagggggagatttctttagacaaaataacacctttcaccccgaatggattccattaaactgcattaagaaaccccctcatggatctgcataaccgcacagacactgacaagcacgcacacacacgcaaatacatgcctttccagtgctgctccctttatcatgtgtttctgtgtagtagctcgtgtgcttagaaacctcaccccattgattggtagttcgaagaattggcagaatcagttgcaataaactcagtcaaatgtacccagcctaccagagatggaccaacgatcctatgagagaagagagtatggtgctgggtccttaaaaaaaaaaatgatacttggtccttaaaaaatatgctctcccctccctttttaaacaaatggcttgttcagtcacttgtttgtgtttgaattgatttttaaacagcaggttgtgtgtgtgtgcagtgatgtggtgggagcacagctttcctgggtctggattcccgtggctttgtgcttatgtcatttcttctctctgtgctggtgggggcctctttaccatagcttaagaagtatccctgatttattctggtgtctaataaacacagattatttgtaaaaaaaaaaaaaaaaaaaaaaa

SEQ ID NO: 166 - DNA, 1968 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaa

SEQ ID NO: 167 - DNA, 1674 bp, Homo sapiens
actgttgagcaggcctctctgcctgtggccttccggccggtttccagacgcccaggtggccaacattagagtccgcgtagcagtgtgagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaa

SEQ ID NO: 168 - DNA, 1825 bp, Homo sapiens
gcgatctacgtttcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaaaaaaaaaaaaaaaaaaaaaaaaaaaaaaaaaaaaaaaaaaaaaaaaaaaaaaaaaaa

SEQ ID NO: 169 - DNA, 1979 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgcctctctgcagattgcaagttcacctgccactaccgctgccgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaa

SEQ ID NO: 170 - DNA, 1979 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcattgcaagttcacctgccactaccgctgccgcgcgctcgtctgcctggactgttgcgggccccgggacctgggctgggaacccgcggtggagcgggacacgaacgtgcccatcttgcaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaa

SEQ ID NO: 171 - DNA, 1876 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaaaaaaaaaaaaaaaaaaaaaaaa

SEQ ID NO: 172 - DNA, 1749 bp, Homo sapiens
tctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcaaaaaaaaaaaa

SEQ ID NO: 173 - DNA, 2555 bp, Homo sapiens
ccggcgcgccgcggggtgagcggcgccgggcctgaggtcgcccagacgccgtcggggcggagccgggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaactacctctcagtctctggggtttgtccttttcctaccctgatgtcaaacttatgcatggatttcattaaaaaagaa

SEQ ID NO: 174 - DNA, 2435 bp, Homo sapiens
ccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcgtcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgaccaccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagt

SEQ ID NO: 175 - DNA, 5060 bp, Homo sapiens
gcacgaggggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatgtcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaaaaaaaaaaaaaaaaaaaaaaaaaaaaaaaaaaaaactcgagggggggcccggtacc

SEQ ID NO: 176 - DNA, 6671 bp, Homo sapiens
aatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagta

SEQ ID NO: 177 - DNA, 2543 bp, Homo sapiens
agccccacatgcccagcaggcatgagtgccatggcctggctcccacagggctatgccaagccaggtgagcccccgcagcacccaggcatgggcctgggctgccactgctactgccaccaggcgtggcatttttattcaggcgacgcttaagggagtccggccgtgcccggtgcattgtgggagcggcccgcagcccgtttttgggaggaggcggagggtgcaaagccagccggtggatccataaagaacccagccaacccacagagggaggggaggggctgagctgtgaggagagcggggcccaagaaccatgtctaagcgggagtcctttaacctggaaagttatgaattggacaaaagcttctggctaaccagattcactgaactgaagggcacaggttgcaaagtgccccaagatgtcttgcaaaaattgctggaatctttacaggagaaccacttccaagaagatgagcagtttctgggagccgttatgccaaggcttcgcattggaatggatacttgtgccattcctttgaggcatggtgggctttccttggttcaaaccacagattacatttacccgatcgtagacgacccttacatgatgggcaggatagcatgtgccaatgtcctcagtgacctctatgcaatgggggtcacagaatgtgacaatatgctgatgctccttggagtcagtaataaaatgaccgacagggaaagggataaagtgatgcctctgattatccaaagttttaaagatgcagctgaggaagcaggaatgtctgtaatggtcagccaaacagtactaaatccctggattgtcctgggaggagtcactaccactgtcttccagcccaatgaatttatcatgccagacaatgcagtgccaggggacgtgctggtgttgacaaaacccctggggacacaggtggcagtggctgtgcaccagtggctggatattccttagaaatggaataagattaagctagtggtcaccgaagatgtagagctggccaaccaggaggcgatgatgaacatggtgaggctcaacaggacagctgcaggactcatgcacacgttcaatgcccacatggccactgacatcacgggcttcgggattttgggccacgtgcagaacctagccaagcagcagaggaacgaggtgtcgtttgtaattcacaacctcctggtgctggccaagatggctgcggtgagcaaggcctgcggaaacatgttcagcctcatgcatgggacctgcccggagacctcaggcggccttctgatctgtttaccatgtcagcaagcagctcggttctgtgcagagataaagtcccccaaatatagtgaaggccaccaagcatggattattgggattgtagagaagggcaaccacacagccagaatcatagacaaaccccagatcatcaaggttgcaccacaagtggccactcaaaatgtgaatctcacacccggggccacatcttaatctagacagaaatagctgtttggttttgtttttaaatagatctatttcccttatcacttcaactaaagactataaacaacaaaaatctcattgtgtctacacatcggggtgaccttaggtcagtttgtaagtggatacaattaataaaataaaatccactgcctttttttcctgttacattaactgaagatgcacctaatcttgaggcagcttctgaattgagaattatattgttatccaatgctgttgattcattttgaatctttagacacttatctcttgccgcataggctctttttaaaggtgctttcacatagcacagacattaccagtagtcatgtcaaatcgcagttggtgtcttcattttatgtatatttatcaagtaagtctgatttttttattaagcatcttgaatggttttctggagagacagcattggtaagtggcacatgatggtatcccagtcataagagggttgcatgattcctttgagtgtttgatttgaaaagcctagtcttgtctctcaagagcatctcggatccagaacattctccagtagtgcattcagttcaacacagcaagtgcttcactgcatggaaaacattttgaagacaaaaaaatcttatatctttttttgtagccttcctgatatttacagtaatacgattaactgttttatcgatagcaaaaaaggatactttttgcaatgtaattagatgttctatagtgctacaaggaattgccttccaaatggaggttcatgtataatactcatttacaattcaatatataattatgcaaataatttttaaatataatgaataataaagactgttctgtggatggtagtgtttaatacattttatattttgtatagtgatttcaggccttttattttcttaaaatcagtagctatttggcctaattcttagcactattttgtcctttgcgccagtacttttttgtgcatgctttttgtgatctgtgttaaaaacctgcattgccaacattgcagctcgaacttaaacttgttattcaaataaatatttaatttttt

SEQ ID NO: 178 - DNA, 2612 bp, Homo sapiens
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacgtctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaaaaaaaaaaaaaa

SEQ ID NO: 179 - DNA, 5333 bp, Homo sapiens
cggctgctcgcgagctgctttctctcctcttccctttccgggtgcacggcgaggagaaagtctctatgcaactaagccccggcgcgcacttggccaggtatgtaccgcgggagcggcgcgttctgcgcggaagcagatgctgctgccgccacggcggcggcggctgccagctcctgagctctgtaactgtcacactgcacctgagctgaacttgaaaagagagtgaaggggcgattgggcgaacgcttttggcagacacagagggtgtttgtagacgtgggggaggagaatctctattaacgccccccaccgtaaccactgcacatcacctccatctctgcaaatacagcccgaggagtagaggcagcagcagctggacccccaaagagagacgtggggcagcggctgtgaccgcatctcctgagctacaacaacaggtcgcctttttgagactcctttggcgggaagggctacttggaaaggaaggtttgaaagagtgagaagggtaggtgtaagggttccctaattcgtcgaaagaattctattgggtgactctcgttcgtcttctctatcctacactccacatactgaccctatattatccagactgtgccggggagaaatcaaaaacacctgtttgaagaaacggctgcacctgtgtgcttatttgtgccagagggtggcctagcccacctgcaggaagagatttggctgggttctgttgagggtgattgttaggacgttgtattttgttgccattattccaaatacctgtcttggagggaaagttgcccttctgagaactgtgactttaccaggagccctatcttggaataagagttacacctctggaccacgtttctcactagtactttgcttgactggaggaagtgggtgacttttggctgcttcggtgacccattgtagacgcctcgttacccttcttccttccgcttcaagtaatcatggcggcgggggtggcagcgtggctgccttttgcaagggcagcggctatcgggtggatgcctgtggcctcggggcctatgccggctcccccgaggcaggagaggaaaaggacccaagatgctctcattgtgctgaatgtgagtggcacccgcttccagacgtggcaggacaccctggaacgttacccagacactctactgggcagttctgagagggactttttctaccacccagaaactcagcagtatttctttgaccgtgacccagacatcttccgccacatcctgaatttctaccgcactgggaagctccactatcctcgccacgagtgcatctctgcttacgatgaagaactggccttctttggcctcatcccggaaatcatcggcgactgctgttatgaggagtacaaggatcgcaggcgagagaacgccgagcgcctgcaggacgacgcggataccgacaccgctggggagagcgccttgcccaccatgactgcaaggcagagggtctggagggccttcgagaacccccacaccagcacgatggccctggtgttctactatgtcacggggtttttcattgccgtctctgtcatcgcgaatgtggtggaaacagtgccgtgcggatcaagcccaggtcacattaaagaactgccctgtggagagcggtatgctgtggccttcttctgcttggacacggcctgcgtcatgatcttcacagttgagtatttgcttcgcctggctgcagcgcctagtcgttaccgttttgtgcgtagtgtcatgagtatcatcgacgtggtggccatcctgccttattacattgggctggtgatgacagacaatgaggacgtcagcggagcctttgtcacactccgagtcttccgggtcttcaggatctttaagttttcccgccactctcaaggcctgcgcatcctggggtacacactgaagagttgtgcctcagaattgggcttcttgcttttctcgctcaccatggctatcatcatcttcgctacagttatgttctacgcagagaaggggtcttcggctagcaagttcaccagcatccctgcagccttctggtataccatcgtcaccatgacaacactagggtatggtgacatggtgccaaaaaccatagcagggaagatttttggttctatctgttcgctgagtggggtcttggtcattgctctacctgttccggtgattgtatccaacttcagtcgcatctaccaccagaatcaacgagcagacaaacgaagggcacaaaagaaagctagactggccaggatccgggcagccaaaagcggaagcgcaaatgcttacatgcagagcaaacggaatggtttactcagtaatcagctgcagtcctcagaggatgagcaggcttttgttagcaaatccggctccagctttgaaacccagcaccaccacctgcttcactgcctggaaaaaaccacgaatcacgagtttgtggacgaacaagtctttgaagaaagctgcatggaagttgcaactgttaatcgtccttcaagtcacagtccttcactgtcttcacaacaaggagtcaccagcacctgctgttcacgacgacacaaaaaaacttttcgcatcccaaatgccaatgtatcaggaagccatcaaggtagtatacaagaactcagcacgattcagatcagatgtgtggagagaacacctctgtctaacagccgatccagtttaaatgccaaaatggaagagtgtgttaaactaaactgtgaacaaccttatgtgactacagcaataataagcatcccaacacctccagtaaccacaccagaaggagacgataggccagaatcccctgagtactcaggaggaaatattgtcagagtttctgctttgtaagacaattggaataaggtctaagagaattcgagccctggctgtgaaaagaatctcaacatagaagaaagaagaaacaataaatattctgcagattaatgcagcaaagaaagaaggttggtagtgaaacacaaagcttccaatcttaaggatgtgaataaaaccaccaaatggcatttctagacagtttgacctgttatacagagtaatattctgtggccctttgactttgtgaatgagcacaatgaaatgccgcctactgatgcttcttatgatcagaactcttttttaataaaataaataacataaatcgttgaacataatgttccagttgaatgcaaaacaaaaaaaatatggaaaacattttgataaaattttttcctgttaaaaccatgaacattggctatgatgaagattattacatatgaaaaaaaaactcacacaacatatttgtattgactgaaggaaaccatcataatgcatgctagaattctttgaagcagtgatctcagtttccttatgttgtcttcagaataggcatgataaactataattgtagaaaggggtaatttctgtgcacttacaacaagctgagtgttcatgttccatggtgggctgtgcaaataaactccttttagacctgcagtatttctcatggggatgctcattagtaaatctaaagtgttcagatagttcagtattcattatcgtttaactttgcacctagatactgttacaactgcaataatttgttgtacaactgttgtatcaggaatcaggatttttttgttgttgtactttccagatccttatagatacggtaagagccacattcgtagaaaaacttctggtgtggccaggttttaggtaactttttaatccaaaactattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgacccatataaattatctctaacgtctttgttgtttatggaaaagcccagatactggatatatcactatgtattttatgaacagaattgactgggactaatatcacaggatcaatcatctcagaatcttacttgatgcattatttattttgctttagatcttgaatacattttgagaataactaatgtggattgaaatgtagagatacactggagtgctttatttagcaatatttgatgaaagcatgctttctacgccattcaggaaggcagcacaaatttatctcagaaaggttcctgtgtattgcaaggtacaattttctccaataaatcaggagaacaggagtttgatgatgcaaagttgatctctgtacatttaagtgaaaagtctttataacttttcacccttaaaatatttcagcagacatgtctgcacatgacagtgtaaaaaagtttaatgtcaaatgcaaagtttttattcattccaagccaccactgtaaggaataaagcttagcttctgtacatggaaagagctaataattatccctctgtcagagatgagatttttaaatgcttatgatatttaatcataaaaagggattaatccaaccattttctagtaaagccagaaattcttgcttcccatttctagaatagtttctagaacagtgctatgcacatattagatcttaataaacatttgctgagtgaaagtaagataaactcaactatctcttgggaagaactggcttcattcctagtacatcttttaaaaagttactaattttccagcagtacaaatattaacaattatattaacacctgcctcatgtcagtttatgcttctagagcaatgtctagtgaaacttatctgatggcatttattgaaaaccttctaaaaagtagactaaggaaaccataatcagaattactatgtcttttgattcccaatgagaagttctattttcatgttcttaatattacatacaagaaaatgcagttaggttatttcaattgacaattctgcctcctcttttgatttatcacttacccaaaattattaattttattaggcttttggaaaagaaaaaaaactttttgatgttttaggtgatttaaaaatataccgtgttggtggtgaatgactattgatgactgtgttaagtgcatctgtattgtaagtgaaatgtaattatttctgtgtaccatatggagtaactaaggtcattgtttttgacaattttgtttgaaattcatatatcttatttcaaaggatagcataatatctgcattatgctggaaaaaaatagacctttggagaatacttaaataaaacatgtgcatgcttgaacaggac

SEQ ID NO: 180 - DNA, 1638 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 181 - DNA, 1665 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtgtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 182 - DNA, 1527 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagaatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 183 - DNA, 1503 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagatgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 184 - DNA, 1759 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgccacccccgtcccttgcaggagcaccctggggagctgtccagagcgctgtgccgctgtctgtggctggaggcagagtaggtggtgtgctgggaatgcgcgtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 185 - DNA, 1739 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacgagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 186 - DNA, 1582 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccactgttctgggtccaggtgctcctggctggccttgtggtccccctcctgcttggggccaccctgacctacacataccgccactgctggcctcacaagcccctggttactgcagatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 187 - DNA, 1471 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggggcactacctgaaggccccttgcacggagccctgcggcaactccacctgccttgtgtgtccccaagacaccttcttggcctgggagaaccaccataattctgaatgtgcccgctgccaggcctgtgatgagcaggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 188 - DNA, 1336 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgttcccgcagagatactgactgtgggacctgcctgcctggcttctatgaacatggcgatggctgcgtgtcctgccccacatgaagctgggatggaggctctgaccccaccaccggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 189 - DNA, 1222 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggcgctcctcctggtgctgctgggggcccgggcccagggcggcactcgtagccccaggtgtgactgtgccggtgacttccacaagaagattggtctgttttgttgcagaggctgcccagcggcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttacttatgcgtgtagacattttatgtcacttattaagccgctggcacggccctgcgtagcagcaccagccggccccacccctgctcgcccctatcgctccagccaaggcgaagaagcacgaacgaatgtcgagagggggtgaagacatttctcaacttctcggccggagtttggctgagatcgcggtattaaatctgtgaaagaaaacaaaacaaaacaaaaaaaaaaaaaaaaaa

SEQ ID NO: 190 - DNA, 2871 bp, Homo sapiens
ccaaacctgaaagaggttgatttgtaatgatttgcaggggggcactggaggcagcggccaggacttttcacttaggagatcagcatttgccctgatggaaactgggcgatcctgcagggactgacctctgagttatccaaaggccgacctggggaaagactgattttgaggttttaatagttttcagatgcttcaagtgttgtgaacagagacttgtttggattatgcatttctcagctagactaaataaatgctagcaatggatacgtgcaaacatgttgggcagctgcagcttgctcaagaccattccagcctcaaccctcagaaatggcactgtgtggactgcaacacgaccgagtccatttgggcttgccttagctgctcccatgttgcctgtggaagatatattgaagagcatgcactcaagcactttcaagaaagcagtcatcctgttgcattggaggtgaatgagatgtacgttttttgttacctttgtgatgattatgttctgaatgataacgcaactggagacctgaagttactacgacgtacattaagtgccatcaaaagtcaaaattatcactgcacaactcgtagtgggaggtttttacggtccatgggtacaggtgatgattcttatttcttacatgacggtgcccaatctctgcttcaaagtgaagatcaactgtatactgctctttggcacaggagaaggatactaatgggtaaaatctttcgaacatggtttgaacaatcacccattggaagaaaaaagcaagaagaaccatttcaggagaaaatagtagtaaaaagagaagtaaagaaaagacggcaggaattggagtatcaagttaaagcagaattggaaagtatgcctccaagaaagagtttacgtttacaagggctcgctcagtcgaccataatagaaatagtttctgttcaggtgccagcacaaacgccagcatcaccagcaaaagataaagtactctctacctcagaaaatgaaatatctcaaaaagtcagtgactcctcagttaaacgaaggccaatagtaactcctggtgtaacaggattgagaaatttgggaaatacttgctatatgaattctgttcttcaggtgttgagtcatttacttatttttcgacaatgttttttaaagcttgatctgaaccaatggctggctatgactgctagcgagaagacaagatcttgtaagcatccaccagtcacagatacagtagtatatcaaatgaatgaatgtcaggaaaaagatacaggttttgtttgctccagacaatcaagtctgtcatcaggactaagtggtggagcatcaaaaggtagaaagatggaacttattcagccaaaggagccaacttcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtttccagaaaggtatcaatgcagtggaaaagatattgcttcccagccatgtctggttactgaaatgttggccaaatttacagaaactgaagctttagaaggaaaaatctacgtatgtgaccagtgtaactcaaagcgtagaaggttttcctccaaaccagttgtactcacagaagcccagaaacaacttatgatatgccacctacctcaggttctcagactgcacctcaaacgattcaggtggtcaggacgtaataaccgagagaagattggtgttcatgttggctttgaggaaatcttaaacatggagccctattgctgcagggagaccctgaaatccctcagaccagaatgctttatctatgacttgtccgcggtggtgatgcaccatgggaaaggatttggctcagggcactacactgcctactgctataattctgaaggagggttctgggtacactgcaatgattccaaactaagcatgtgcactatggatgaagtatgcaaggctcaagcttatatcttgttttatacccaacgagttactgagaatggacattctaaacttttgcctccagagctcctgttggggagccaacatcccaatgaagacgctgatacctcgtctaatgaaatccttagctgatccaaagacaatggggttttcttcctgtgatttatatatatactttttaaaagactgatgtaccattttaaacttcattttttcttgtgaatcagtgtatactacatttatacattttatatctaacaattttttttttttacaaagtataaatgtatatatcaactgaaggtaactacttttttcatatttggagttttaaacttttggtgtttacctcagactgatgttacctcttttatatttttatgtcttaattggctcggatgatgaacttgtgcaatcttctaccaacaaagttcaagtggcatcattttatatacatgtatctttttcaggtattttctatacaaattcttaatagatggaaaattagactctaaaaaaaaaaaaaaaaaaaaaaaaaaaaaaaaaaaaaaaaaaaaaaaaaaaaggggcggccgctctaaaaaaaaaaaaaaaaaaaaaaaaaaaaaaaaagg

SEQ ID NO: 191 - DNA, 3130 bp, Homo sapiens
gcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaaaaaaaaaaaaaaaa

SEQ ID NO: 192 - DNA, 3172 bp, Homo sapiens
ggagggggcagttgggcggggataggccgtcctagctaaggtggtaaaggccaataactcttcaggctgcctctcctcgaaaagtcatcttctcgcgaacctttaaaatgccttcctccccaagcacctcaagggactagaactgagtgcttcatttgtcttttttcctccttgcaaaagtcccgtttgccaccatggggatgtaccaagtgagaccgagtagggggaacgagtggtgattgacgcgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtacatgcagtccgagatcgccatggatcggatgaagaagatcaaacggcagctgtcaatgacactccgaggtggccgaggcatagacaagaccaatggtgcccctgagcagataggcctggatgagagtggtggtggtggcggcagtgaccctggagaggcccccacacgtgctgctcctggggaacttcgttctgcacggggcccactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgtttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaaaaaaaaaaaaaaaa

SEQ ID NO: 193 - DNA, 2987 bp, Homo sapiens
gcggagcgcggcgcgcgcggcggttgggccgttggctgttcggccctgggatccgccgccactccgcgatcagaccgctctgtgccgcgagccgccgtgagcactcggattcaagccggcgccaacgagtccgggggcatcgcccgcagcggccaagctcatggccggctgagcgggacgccgcctccgcctcagccaccgccgccgccgccgcctcctcctcctcagccggcggcggcccgggcccagcaaccatggctgaagactactgggacgggcgcctgcggcgaacaggaggagaaggaggtcgcgcggcctcatcccgggccgccgccccaggcgccgccgcgccggccccgcggctctgaggttgctcgcgcgcccccgccgatcgccatggatcggatgaagaagatcaaacggcagctgtcaatgacactcagctctgcaccagagattgtgcacgaggacttgaagatggggtctgatggggagagtgaccaggcttcagccacgtcctcggatgaggtgcagtctccagtgagagtgcgtatgcgcaaccatcccccacgcaagatctccactgaggacatcaacaagcgcctatcactaccagctgacatccggctgcctgagggctacctggagaagctgaccctcaatagccccatctttgacaagcccctcagccgccgcctccgtcgtgtcagcctatctgagattggctttgggaaactggagacctacattaagctggacaaactgggcgagggtacctatgccaccgtctacaaaggcaaaagcaagctcacagacaaccttgtggcactcaaggagatcagactggaacatgaagagggggcaccctgcaccgccatccgggaagtgtccctgctcaaggacctcaaacacgccaacatcgttacgctacatgacattatccacacggagaagtccctcacccttgtctttgagtacctggacaaggacctgaagcagtacctggatgactgtgggaacatcatcaacatgcacaacgtgaaactgttcctgttccagctgctccgtggcctggcctactgccaccggcagaaggtgctacaccgagacctcaagccccagaacctgctcatcaacgagaggggagagctcaagctggctgactttggcctggcccgagccaagtcaatcccaacaaagacatactccaatgaggtggtgacactgtggtaccggccccctgacatcctgcttgggtccacggactactccactcagattgacatgtggggtgtgggctgcatcttctatgagatggccacaggccgtcccctctttccgggctccacggtggaggaacagctacacttcatcttccgtatcttaggaaccccaactgaggagacgtggccaggcatcctgtccaacgaggagttcaagacatacaactaccccaagtaccgagccgaggcccttttgagccacgcaccccgacttgatagcgacggggccgacctcctcaccaagctgttgcagtttgagggtcgaaatcggatctccgcagaggatgccatgaaacatccattcttcctcagtctgggggagcggatccacaaacttcctgacactacttccatatttgcactaaaggagattcagctacaaaaggaggccagccttcggtcttcgtcgatgcctgactcaggcaggccagctttccgcgtggtggacaccgagttctaagccacagaccgaggccccagcaggcagcggctggagggatgccacacccctcacagggcagcccccaactacatcttccctgcttactctctgcctacctgcctgagccatgttcacctgcccacttgtcccctgctgcctgcccaaacaccccaccattggcctgtcaacccacccattggcctgtctgctgggtgctaacaaagctctcatcactccttcacttggtctgtctgtctctgtcttggtagttgccggtggacagcatggccgtgccagcctcccacactgaggccaggtctaccccccatcataccagcccccaggaccactaccccacggccagccaggggtccagagctagcccaggctggggatctcgactcagacaagatggtgacaatgccttgagtctgaggcatcctctgcctgctttcctgcctgccccacctgcctcatattgtgtgggcctttttttgtttgtttcattcattgttttttttttttttaattattttaaatgagatttttgttttttttaaatgcaatatctctgtatacagactggctgggccccaccccctgcgtgtggccctcccacagtattttgtgcaatgaagccctgctcccagcctttcagagacagggacacagcccctatttggaaccctgatcatcaccagaccctgggattggctatgggaaagcatgccacagccactcgccttcctacccccgcccgccatccccagttgcagggggatctggggactaccagagactctgggaaatggacaaggtggggggccccactctttctctcctgcagtcccgtagctggggcctccttccttctcagggtctccccagcccagtccccttgctcccatcccactcggtgctgttgggtaggggccctgccaggaactgaccagctcagcgaggagccataatgtgcatatgtgcacaagcagggttgggggaggggggtgtgaggggttgtgcccaggtgttgccccctatctcctggggagggtgaggcagggcagggacagtctccagggtcagtccctggatgggtggttacctccccttcctccaccctaagccctggggccctgaaatggggtgggagggcaggggtgggagccctcctagtgggtttggggggttgggttcctgaatgcaccataatcgctgtatgaaatattaaaaagtctaaagtgaaaaaaaaaaaaaaaaaa

SEQ ID NO: 194 - protein, 629 aa, Homo sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 195 - protein, 457 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 196 - protein, 423 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKVQTPDKQPLRPLVPDASKQRLMENTEDWRPRPGTGQSRSFRILAHLTGTEFMQDPDEEHLKKSSQVPRTEAPAPASSTPQEPWPGPTAPSPTSRPPWAVDPAFAERYAPDKTSTVLTRHSQPATPTPLQSRTSIVQAAAGGVPGGGSNNGKTPVCHQCHKVIRGRYLVALGHAYHPEEFVCSQCGKVLEEGGFFEEKGAIFCPPCYDVRYAPSCAKCKKKITGEIMHALKMTWHVHCFTCAACKTPIRNRAFYMEEGVPYCERDYEKMFGTKCHGCDFKIDAGDRFLEALGFSWHDTCFVCAICQINLEGKTFYSKKDRPLCKSHAFSHV

SEQ ID NO: 197 - protein, 153 aa, Homo sapiens
MDSFKVVLEGPAPWGFRLQGGKDFNVPLSISRLTPGGKAAQAGVAVGDWVLSIDGENAGSLTHIEAQNKIRACGERLSLGLSRAQPVQSKPQKASAPAADPPRYTFAPSVSLNKTARPFGAPPPADSAPQQNGCRPLTNSRSDRWSQMPASSG

SEQ ID NO: 198 - protein, 1312 aa, Homo sapiens
MSRIEKMSILGVRSFGIEDKDKQIITFFSPLTILVGPNGAGKTTIIECLKYICTGDFPPGTKGNTFVHDPKVAQETDVRAQIRLQFRDVNGELIAVQRSMVCTQKSKKTEFKTLEGVITRTKHGEKVSLSSKCAEIDREMISSLGVSKAVLNNVIFCHQEDSNWPLSEGKALKQKFDEIFSATRYIKALETLRQVRQTQGQKVKEYQMELKYLKQYKEKACEIRDQITSKEAQLTSSKEIVKSYENELDPLKNRLKEIEHNLSKIMKLDNEIKALDSRKKQMEKDNSELEEKMEKVFQGTDEQLNDLYHNHQRTVREKERKLVDCHRELEKLNKESRLLNQEKSELLVEQGRLQLQADRHQEHIRARDSLIQSLATQLELDGFERGPFSERQIKNFHKLVRERQEGEAKTANQLMNDFAEKETLKQKQIDEIRDKKTGLGRIIELKSEILSKKQNELKNVKYELQQLEGSSDRILELDQELIKAERELSKAEKNSNVETLKMEVISLQNEKADLDRTLRKLDQEMEQLNHHTTTRTQMEMLTKDKADKDEQIRKIKSRHSDELTSLLGYFPNKKQLEDWLHSKSKEINQTRDRLAKLNKELASSEQNKNHINNELKRKEEQLSSYEDKLFDVCGSQDFESDLDRLKEEIEKSSKQRAMLAGATAVYSQFITQLTDENQSCCPVCQRVFQTEAELQEVISDLQSKLRLAPDKLKSTESELKKKEKRRDEMLGLVPMRQSIIDLKEKEIPELRNKLQNVNRDIQRLKNDIEEQETLLGTIMPEEESAKVCLTDVTIMERFQMELKDVERKIAQQAAKLQGIDLDRTVQQVNQEKQEKQHKLDTVSSKIELNRKLIQDQQEQIQHLKSTTNELKSEKLQISTNLQRRQQLEEQTVELSTEVQSLYREIKDAKEQVSPLETTLEKFQQEKEELINKKNTSNKIAQDKLNDIKEKVKNIHGYMKDIENYIQDGKDDYKKQKETELNKVIAQLSECEKHKEKINEDMRLMRQDIDTQKIQERWLQDNLTLRKRNEELKEVEEERKQHLKEMGQMQVLQMKSEHQKLEENIDNIKRNHNLALGRQKGYEEEIIHFKKELREPQFRDAEEKYREMMIVMRTTELVNKDLDIYYKTLDQAIMKFHSMKMEEINKIIRDLWRSTYRGQDIEYIEIRSDADENVSASDKRRNYNYRVVMLKGDTALDMRGRCSAGQKVLASLIIRLALAETFCLNCGIIALDEPTTNLDRENIESLAHALVEIIKSRSQQRNFQLLVITHDEDFVELLGRSEYVEKFYRIKKNIDQCSEIVKCSVSSLGFNVH

SEQ ID NO: 199 - protein, 380 aa, Homo sapiens
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 200 - protein, 1836 aa, Homo sapiens
MARPSLCTLARLGPECLRPFTRESLAAIEQRAVEEEARLQRNKQMEIEEPERKPRSDLEAGKNLPMIYGDPPPEVIGIPLEDLDPYYSNKKTFIVLNKGKAIFRFSATPALYLLSPFSVVRRGAIKVLIHALFSMFIMITILTNCVFMTMSDPPPWSKNVEYTFTGIYTFESLIKILARGFCVDDFTFLRDPWNWLDFSVIMMAYLTEFVDLGNISALRTFRVLRALKTITVIPGLKTIVGALIQSVKKLSDVMILTVFCLSVFALVGLQLFMGNLRQKCVRWPPPFNDTNTTWYSNDTWYGNDTWYGNEMWYGNDSWYANDTWNSHASWATNDTFDWDAYISDEGNFYFLEGSNDALLCGNSSDAGHCPKGYECIKTGRNPNYGYTSYDTFSWAFLALFRLMTQDYWENLFQLTLRAAGKTYMIFFVVIIFLGSFYLINLILAVVAMAYAEQNEATLAEDKEKEEEFQQMLEKFKKHQEELEKAKAAQALEGGEADGDPAHGKDCNGSLDTSQGEKGAPRQSGSGDSGISDAMEELEEAHQKCPPWWYKCAHKVLIWDCCAPWLKFKNIIHLIVMDPFVDLGITICIVLNTLFMAMEHYPMTEHFDNVLTVGNLVFTGIFTAEMVLKLIAMDPYEYFQQGWNIFDSIIVTLSLVELGLANVQGLSVLRSFRLLRVFKLAKSWPTLNMLIKIIGNSVGALGNLTLVLAIIVFIFAVVGMQLFGKSYKECVCKIALDCNLPRWHMHDFFHSFLIVFRILCGEWIETMWDCMEVAGQAMCLTVFLMVMVIGNLVVLNLFLALLLSSFSADSLAASDEDGEMNNLQIAIGRIKLGIGFAKAFLLGLLHGKILSPKDIMLSLGEADGAGEAGEAGETAPEDEKKEPPEEDLKKDNHILNHMGLADGPPSSLELDHLNFINNPYLTIQVPIASEESDLEMPTEEETDTFSEPEDSKKPPQPLYDGNSSVCSTADYKPPEEDPEEQAEENPEGEQPEECFTEACVQRWPCLYVDISQGRGKKWWTLRRACFKIVEHNWFETFIVFMILLSSGALAFEDIYIEQRRVIRTILEYADKVFTYIFIMEMLLKWVAYGFKVYFTNAWCWLDFLIVDVSIISLVANWLGYSELGPIKSLRTLRALRPLRALSRFEGMRVVVNALLGAIPSIMNVLLVCLIFWLIFSIMGVNLFAGKFYYCINTTTSERFDISEVNNKSECESLMHTGQVRWLNVKVNYDNVGLGYLSLLQVATFKGWMDIMYAAVDSREKEEQPQYEVNLYMYLYFVIFIIFGSFFTLNLFIGVIIDNFNQQKKKLGGKDIFMTEEQKKYYNAMKKLGSKKPQKPIPRPQNKIQGMVYDLVTKQAFDITIMILICLNMVTMMVETDDQSQLKVDILYNINMIFIIIFTGECVLKMLALRQYYFTVGWNIFDFVVVILSIVGLALSDLIQKYFVSPTLFRVIRLARIGRVLRLIRGAKGIRTLLFALMMSLPALFNIGLLLFLVMFIYSIFGMSNFAYVKKESGIDDMFNFETFGNSIICLFEITTSAGWDGLLNPILNSGPPDCDPNLENPGTSVKGDCGNPSIGICFFCSYIIISFLIVVNMYIAIILENFNVATEESSEPLGEDDFEMFYETWEKFDPDATQFIAYSRLSDFVDTLQEPLRIAKPNKIKLITLDLPMVPGDKIHCLDILFALTKEVLGDSGEMDALKQTMEEKFMAANPSKVSYEPITTTLKRKHEEVCAIKIQRAYRRHLLQRSMKQASYMYRHSHDGSGDDAPEKEGLLANTMSKMYGHENGNSSSPSPEEKGEAGDAGPTMGLMPISPSDTAWPPAPPPGQTVRPGVKESLV

SEQ ID NO: 201 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 202 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 203 - protein, 389 aa, Homo sapiens
MPTVYLCSEQIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 204 - protein, 372 aa, Homo sapiens; identical to SEQ ID NO: 202

SEQ ID NO: 205 - protein, 372 aa, Homo sapiens; identical to SEQ ID NO: 202

SEQ ID NO: 206 - protein, 472 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 207 - protein, 495 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 208 - protein, 914 aa, Homo sapiens
MGPFKSSVFILILHLLEGALSNSLIQLNNNGYEGIVVAIDPNVPEDETLIQQIKDMVTQASLYLFEATGKRFYFKNVAILIPETWKTKADYVRPKLETYKNADVLVAESTPPGNDEPYTEQMGNCGEKGERIHLTPDFIAGKKLAEYGPQGKAFVHEWAHLRWGVFDEYNNDEKFYLSNGRIQAVRCSAGITGTNVVKKCQGGSCYTKRCTFNKVTGLYEKGCEFVLQSRQTEKASIMFAQHVDSIVEFCTEQNHNKEAPNKQNQKCNLRSTWEVIRDSEDFKKTTPMTTQPPNPTFSLLQIGQRIVCLVLDKSGSMATGNRLNRLNQAGQLFLLQTVELGSWVGMVTFDSAAHVQSELIQINSGSDRDTLAKRLPAAASGGTSICSGLRSAFTVIRKKYPTDGSEIVLLTDGEDNTISGCFNEVKQSGAIIHTVALGPSAAQELEELSKMTGGLQTYASDQVQNNGLIDAFGALSSGNGAVSQRSIQLESKGLTLQNSQWMNGTVIVDSTVGKDTLFLITWTTQPPQILLWDPSGQKQGGFVVDKNTKMAYLQIPGIAKVGTWKYSLQASSQTLTLTVTSRASNATLPPITVTSKTNKDTSKFPSPLVVYANIRQGASPILRASVTALIESVNGKTVTLELLDNGAGADATKDDGVYSRYFTTYDTNGRYSVKVRALGGVNAARRRVIPQQSGALYIPGWIENDEIQWNPPRPEINKDDVQHKQVCFSRTSSGGSFVASDVPNAPIPDLFPPGQITDLKAEIHGGSLINLTWTAPGDDYDHGTAHKYIIRISTSILDLRDKFNESLQVNTTALIPKEANSEEVFLFKPENITFENGTDLFIAIQAVDKVDLKSEISNIARVSLFIPPQTPPETPSPDETSAPCPNIHINSTIPGIHILKIMWKWIGELQLSIA

SEQ ID NO: 209 - protein, 869 aa, Homo sapiens
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVGKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 210 - protein, 472 aa, Homo sapiens
MAGASRLLFLWLGCFCVSLAQGERPKPPFPELRKAVPGDRTAGGGPDSELQPQDKVSEHMLRLYDRYSTVQAARTPGSLEGGSQPWRPRLLREGNTVRSFRAAAAETLERKGLYIFNLTSLTKSENILSATLYFCIGELGNISLSCPVSGGCSHHAQRKHIQIDLSAWTLKFSRNQSQLLGHLSVDMAKSHRDIMSWLSKDITQFLRKAKENEEFLIGFNITSKGRQLPKRRLPFPEPYILVYANDAAISEPESVVSSLQGHRNFPTGTVPKWDSHIRAALSIERRKKRSTGVLLPLQNNELPGAEYQYKKDEVWEERKPYKTLQAQAPEKSKNKKKQRKGPHRKSQTLQFDEQTLKKARRKQWIEPRNCARRYLKVDFADIGWSEWIISPKSFDAYYCSGACQFPMPKSLKPSNHATIQSIVRAVGVVPGIPEPCCVPEKMSSLSILFFDENKNVVLKVYPNMTVESCACR

SEQ ID NO: 211 - protein, 1642 aa, Homo sapiens
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 212 - protein, 1642 aa, Homo sapiens; identical to SEQ ID NO: 211

SEQ ID NO: 213 - protein, 524 aa, Homo sapiens
MENKEAGTPPPIPSREGRLQPTLLLATLSAAFGSAFQYGYNLSVVNTPHKVGTSCGWGNVFQVFKSFYNETYFERHATFMDGKLMLLLWSCTVSMFPLGGLLGSLLVGLLVDSCGRKGTLLINNIFAIIPAILMGVSKVAKAFELIVFSRVVLGVCAGISYSALPMYLGELAPKNLRGMVGTMTEVFVIVGVFLAQIFSLQAILGNPAGWPVLLALTGVPALLQLLTLPFFPESPRYSLIQKGDEATARQALRRLRGHTDMEAELEDMRAEARAERAEGHLSVLHLCALRSLRWQLLSIIVLMAGQQLSGINAINYYADTIYTSAGVEAAHSQYVTVGSGVVNIVMTITSAVLVERLGRRHLLLAGYGICGSACLVLTVVLLFQNRVPELSYLGIICVFAYIAGHSIGPSPVPSVVRTEIFLQSSRRAAFMVDGAVHWLTNFIIGFLFPSIQEAIGAYSFIIFAGICLLTAIYIYVVIPETKGKTFVEINRIFAKRNRVKLPEEKEETIDAGPPTASPAKETSF

SEQ ID NO: 214 - protein, 727 aa, Homo sapiens
MAFQKAVKGTILVGGGALATVLGLSQFAHYRRKQMNLAYVKAADCISEPVNREPPSREAQLLTLQNTSEFDILVIGGGATGSGCALDAVTRGLKTALVERDDFSSGTSSRSTKLIHGGVRYLQKAIMKLDIEQYRMVKEALHERANLLEIAPHLSAPLPIMLPVYKWWQLPYYWVGIKLYDLVAGSNCLKSSYVLSKSRALEHFPMLQKDKLVGAIVYYDGQHNDARMNLAIALTAARYGAATANYMEVVSLLKKTDPQTGKVHVSGARCKDVLTGQEFDVRAKCVINATGPFTDSVRKMDDKDAAAICQPSAGVHIVMPGYYSPESMGLLDPATSDGRVIFFLPWQKMTIAGTTDTPTDVTHHPIPSEEDINFILNEVRNYLSCDVEVRRGDVLAAWSGIRPLVTDPKSADTQSISRNHVVDISESGLITIAGGKWTTYRSMAEDTINAAVKTHNLKAGPSRTVGLFLQGGKDWSPTLYIRLVQDYGLESEVAQHLAATYGDKAFEVAKMASVTGKRWPIVGVHLVSEFPYIEAEVKYGIKEYACTAVDMISRRTRLAFLNVQAAEEALPRIVELMGRELNWDDYKKQEQLETARKFLYYEMGYKSRSEQLTDRSEISLLPSDIDRYKKRFHKFDADQKGFITIVDVQRVLESINVQMDENTLHEILNEVDLNKNGQVELNEFLQLMSAIQKGRVSGSRLAILMKTAEENLDRRVPIPVDRSCGGL

SEQ ID NO: 215 - protein, 639 aa, Homo sapiens
MLLRKRYRHRPCRLQFLLLLLMLGCVLMMVAMLHPPHHTLHQTDTAQASKHSPEARYRLDFGESQDWVLEAEDEGEEYSPLEGLPPFISLREDQLLVAVALPQARRNQSQGRRGGSYRLIKQPRRQDKEAPKRDWGADEDGEVSEEEELTPFSLDPRGLQEALSARIPLQRALPEVRHPLCLQQHPQDSLPTASVILCFHDEAWSTLLRTVHSILDTVPRAFLKEIILVDDLSQQGQLKSALSEYVARLEGVKLLRSNKRLGAIRARMLGATRATGDVLVFMDAHCECHPGWLEPLLSRIAGDRSRVVSPVIDVIDWKTFQYYPSKDLQRGVLDWKLDFHWEPLPEHVRKALQSPISPIRSPVVPGEVVAMDRHYFQNTGAYDSLMSLRGGENLELSFKAWLCGGSVEILPCSRVGHIYQNQDSHSPLDQEATLRNRVRIAETWLGSFKETFYKHSPEAFSLSKAEKPDCMERLQLQRRLGCRTFHWFLANVYPELYPSEPRPSFSGKLHNTGLGLCADCQAEGDILGCPMVLAPCSDSRQQQYLQHTSRKEIHFGSPQHLCFAVRQEQVILQNCTEEGLAIHQQHWDFQENGMIVHILSGKCMEAVVQENNKDLYLRPCDGKARQQWRFDQINAVDER

SEQ ID NO: 216 - protein, 384 aa, Homo sapiens
MAFPCRRSLTAKTLACLLVGVSFLALQQWFLQAPRSPREERSPQEETPEGPTDAPAADEPPSELVPGPPCVANASANATADFEQLPARIQDFLRYRHCRHFPLLWDAPAKCAGGRGVFLLLAVKSAPEHYERRELIRRTWGQERSYGGRPVRRLFLLGTPGPENEARAERLAELVALEAREHGDVLQWAFADTFLNLTLKHLHLLDWLAARCPHARFLLSGDDDVFVHTANVVRFLQAQPPGRHLFSGQLMEGSVPIRDSWSKYFVPPQLFPGSAYPVYCSGGGFLLSGPTARALRAAARHTPLFPIDDAYMGMCLERAGLAPSGHEGIRPFGVQLPGAQQSSFDPCMYRELLLVHRFAPYEMLLMWKALHSPALSCDRGHRVS

SEQ ID NO: 217 - protein, 169 aa, Homo sapiens
MPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQTQCECSDLKLTNPPSLKEKKVKAVSR

SEQ ID NO: 218 - protein, 117 aa, Homo sapiens [sequence omitted]

SEQ ID NO: 219 - protein, 533 aa, Homo sapiens
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHNYSQDAADACDIDEIEEVPTTSHRLSRHDKAVQRFCLIGSLSKHESEYNTTRV

SEQ ID NO: 220 - protein, 532 aa, Homo sapiens
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHNYSQDAADACDIDEIEEVPTTSHRLSRHDKAVQRFCLIGSLSKHESEYNTTRV

SEQ ID NO: 221 - protein, 173 aa, Homo sapiens
MSTMGNEASYPAEMCSHFDNDEIKRLGRRFKKLDLDKSGSLSVEEFMSLPELRHNPLVRRVIDVFDTDGDGEVDFKEFILGTSQFSVKGDEEQKLRFAFSIYDMDKDGYISNGELFQVLKMMVGNNLTDWQLQQLVDKTIIILDKDGDGKISFEEFSAVVRDLEIHKKLVLIV

SEQ ID NO: 222 - protein, 1297 aa, Homo sapiens
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 223 - protein, 921 aa, Homo sapiens
MFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDSRSLMNGRCLGSRSR

SEQ ID NO: 224 - protein, 340 aa, Homo sapiens
  misc_feature (245)..(245): Xaa can be any naturally occurring amino acid
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQXVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 225 - protein, 333 aa, Homo sapiens [sequence omitted]

SEQ ID NO: 226 - protein, 333 aa, Homo sapiens [sequence omitted]

SEQ ID NO: 227 - protein, 350 aa, Homo sapiens
MIFEKLRICSMPQFFCFMQDLPPLKYDPDVVVTDFRFGTIPVKLYQSKASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYCFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGL

SEQ ID NO: 228 - protein, 457 aa, Homo sapiens
MLLPQLCWLPLLAGLLPPVPAQKFSALTFLRVDQDKDKDCSLDCAGSPQKPLCASDGRTFLSRCEFQRAKCKDPQLEIAYRGNCKDVSRCVAERKYTQEQARKEFQQVFIPECNDDGTYSQVQCHSYTGYCWCVTPNGRPISGTAVAHKTPRCPGSVNEKLPQREGTGKTVSLQIFSVLNSDDAAAPALETQPQGDEEDIASRYPTLWTEQVKSRQNKTNKNSVSSCDQEHQSALEEAKQPKNDNVVIPECAHGGLYKPVQCHPSTGYCWCVLVDTGRPIPGTSTRYEQPKCDNTARAHPAKARDLYKGRQLQGCPGAKKHEFLTSVLDALSTDMVHAASDPSSSSGRLSEPDPSHTLEERVVHWYFKLLDKNSSGDIGKKEIKPFKRFLRKKSKPKKCVKKFVEYCDVNNDKSISVQELMGCLGVAKEDGKADTKKRHTPRGHAESTSNRQPRKQG

SEQ ID NO: 229 - protein, 98 aa, Homo sapiens
MGQLFPKPGECLHARRRDSFCQQLAWHLLCKHLKHVPRCGRPDAQDGHSAPPSSPPLLASRVAASTRETIVPVEAARMSVIYAPSCSCKRTRASAGPT

SEQ ID NO: 230 - protein, 934 aa, Homo sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPQYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSSPASVMVAKEDRN

SEQ ID NO: 231 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 232 - protein, 368 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVCDCVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 233 - protein, 834 aa, Homo sapiens
MWGLGARGPDRGLLLALALGGLARAGGVEVEPGGAHGESGGFQVVTFEWAHVQDPYVIALWILVASLAKIGFHLSHKVTSVVPESALLIVLGLVLGGIVWAADHIASFTLTPTVFFFYLLPPIVLDAGYFMPNRLFFGNLGTILLYAVVGTVWNAATTGLSLYGVFLSGLMGDLQIGLLDFLLFGSLMAAVDPVAVLAVFEEVHVNEVLFIIVFGESLLNDAVTVVLYNVFESFVALGGDNVTGVDCVKGIVSFFVVSLGGTLVGVVFAFLLSLVTRFTKHVRIIEPGFVFIISYLSYLTSEMLSLSAILAITFCGICCQKYVKANISEQSATTVRYTMKMLASSAETIIFMFLGISAVNPFIWTWNTAFVLLTLVFISVYRAIGVVLQTWLLNRYRMVQLEPIDQVVLSYGGLRGAVAFALVVLLDGDKVKEKNLFVSTTIIVVFFTVIFQGLTIKPLVQWLKVKRSEHREPRLNEKLHGRAFDHILSAIEDISGQIGHNYLRDKWSHFDRKFLSRVLMRRSAQKSRDRILNVFHELNLKDAISYVAEGERRGSLAFIRSPSTDNVVNVDFTPRSSTVEASVSYLLRENVSAVCLDMQSLEQRRRSIRDAEDMVTHHTLQQYLYKPRQEYKHLYSRHELTPTEDEKQDREIFHRTMRKRLESFKSTKLGLNQNKKAAKLYKRERAQKRRNSSIPNGKLPMESPAQNFTIKEKDLELSDTEEPPNYDEEMSGGIEFLASVTKDTASDSPAGIDNPVFSPDEALDRSLLARLPPWLSPGETVVPSQRARTQIPYSPGTFRRLMPFRLSSKSVDSFLQADGPEERPPAALPESTHM

SEQ ID NO: 234 - protein, 478 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 235 - protein, 510 aa, Homo sapiens
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 236 - protein, 815 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 237 - protein, 453 aa, Homo sapiens
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 238 - protein, 477 aa, Homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 239 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 240 - protein, 912 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSRSATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQRLQYPTHLINPSASHSDTPETEETEMKALGERVSIL

SEQ ID NO: 241 - protein, 433 aa, Homo sapiens
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 242 - protein, 797 aa, Homo sapiens
MAHRCLRLWGRGGCWPRGLQQLLVPGGVGPGEQPCLRTLYRFVTTQARASRNSLLTDIIAAYQRFCSRPPKGFGKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRASEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 243 - protein, 1085 aa, Homo sapiens
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYGTIFLTFMTLVVFVGVKYVNKFASLFLACVIISILSIYAGGIKSIFDPPVFPVCMLGNRTLSRDQFDICAKTAVVDNETVATQLWSFFCHSPNLTTDSCDPYFMLNNVTEIPGIPGAAAGVLQENLWSAYLEKGDIVEKHGLPSADAPSLKESLPLYVVADIATSFTVLVGIFFPSVTGIMAGSNRSGDLRDAQKSIPVGTILAIITTSLVYFSSVVLFGACIEGVVLRDKYGDGVSRNLVVGTLAWPSPWVIVIGSFFSTCGAGLQSLTGAPRLLQAIAKDNIIPFLRVFGHGKVNGEPTWALLLTALIAELGILIASLDMVAPILSMFFLMCYLFVNLACAVQTLLRTPNWRPRFKYYHWALSFLGMSLCLALMFVSSWYYALVAMLIAGMIYKYIEYQGAEKEWGDGIRGLSLSAARYALLRLEEGPPHTKNWRPQLLVLLKLDEDLHVKYPRLLTFASQLKAGKGLTIVGSVIQGSFLESYGEAQAAEQTIKNMMEIEKVKGFCQVVVASKVREGLAHLIQSCGLGGMRHNSVVLGWPYGWRQSEDPRAWKTFIDTVRCTTAAHLALLVPKNIAFYPSNHERYLEGHIDVWWIVHDGGMLMLLPFLLRQHKVWRKCRMRIFTVAQMDDNSIQMKKDLAVFLYHLRLEAEVEVVEMHNSDISAYTYERTLMMEQRSQMLRQMRLTKTEREREAQLVKDRHSALRLESLYSDEEDESAVGADKIQMTWTRDKYMTETWDPSHAPDNFRELVHIKPDQSNVRRMHTAVKLNEVIVTRSHDARLVLLNMPGPPRNSEGDENYMEFLEVLTEGLERVLLVRGGGREVITIYS

SEQ ID NO: 244 - protein, 428 aa, Homo sapiens
MATSWGTVFFMLVVSCVCSAVSHRNQQTWFEGIFLSSMCPINVSASTLYGIMFDAGSTGTRIHVYTFVQKMPGQLPILEGEVFDSVKPGLSAFVDQPKQGAETVQGLLEVAKDSIPRSHWKKTPVVLKATAGLRLLPEHKAKALLFEVKEIFRKSPFLVPKGSVSIMDGSDEGILAWVTVNFLTGQLHGHRQETVGTLDLGGASTQITFLPQFEKTLEQTPRGYLTSFEMFNSTYKLYTHSYLGFGLKAARLATLGALETEGTDGHTFRSACLPRWLEAEWIFGGVKYQYGGNQEGEVGFEPCYAEVLRVVRGKLHQPEEVQRGSFYAFSYYYDRAVDTDMIDYEKGGILKVEDFERKAREVCDNLENFTSGSPFLCMDLSYITALLKDGFGFADSTVLQLTKKVNNIETGWALGATFHLLQSLGISH

SEQ ID NO: 245 - protein, 419 aa, Homo sapiens
MTTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 246 - protein, 393 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 247 - protein, 393 aa, Homo sapiens; identical to SEQ ID NO: 246

SEQ ID NO: 248 - protein, 334 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 249 - protein, 278 aa, Homo sapiens
MELGRGAYGVVEKMRHVPSGQIMAVKRIRATVNSQEQKRLLMDLDISMRTVDCPFTVTFYGALFREGDMWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 250 - protein, 1138 aa, Homo sapiens
MVWRVPPFLLPILFLASHVGAAVDLTLLANLRLTDPQRFFLTCVSGEAGAGRGSDAWGPPLLLEKDDRIVRTPPGPPLRLARNGSHQVTLRGFSKPSDLVGVFSCVGGAGARRTRVIYVHNSPGAHLLPDKVTHTVNKGDTAVLSARVHKEKQTDVIWKSNGSYFYTLDWHEAQDGRFLLQLPNVQPPSSGIYSATYLEASPLGSAFFRLIVRGCGAGRWGPGCTKECPGCLHGGVCHDHDGECVCPPGFTGTRCEQACREGRFGQSCQEQCPGISGCRGLTFCLPDPYGCSCGSGWRGSQCQEACAPGHFGADCRLQCQCQNGGTCDRFSGCVCPSGWHGVHCEKSDRIPQILNMASELEFNLETMPRINCAAAGNPFPVRGSIELRKPDGTVLLSTKAIVEPEKTTAEFEVPRLVLADSGFWECRVSTSGGQDSRRFKVNVKVPPVPLAAPRLLTKQSRQLVVSPLVSFSGDGPISTVRLHYRPQDSTMDWSTIVVDPSENVTLMNLRPKTGYSVRVQLSRPGEGGEGAWGPPTLMTTDCPEPLLQPWLEGWHVEGTDRLRVSWSLPLVPGPLVGDGFLLRLWDGTRGQERRENVSSPQARTALLTGLTPGTHYQLDVQLYHCTLLGPASPPAHVLLPPSGPPAPRHLHAQALSDSEIQLTWKHPEALPGPISKYVVEVQVAGGAGDPLWIDVDRPEETSTIIRGLNASTRYLFRMRASIQGLGDWSNTVEESTLGNGLQAEGPVQESRAAEEGLDQQLILAVVGSVSATCLTILAALLTLVCIRRSCLHRRRTFTYQSGSGEETILQFSSGTLTLTRRPKLQPEPLSYPVLEWEDITFEDLIGEGNFGQVIRAMIKKDGLKMNAAIKMLKEYASENDHRDFAGELEVLCKLGHHPNIINLLGACKNRGYLYIAIEYAPYGNLLDFLRKSRVLETDPAFAREHGTASTLSSRQLLRFASDAANGMQYLSEKQFIHRDLAARNVLVGENLASKIADFGLSRGEEVYVKKTMGRLPVRWMAIESLNYSVYTTKSDVWSFGVLLWEIVSLGGTPYCGMTCAELYEKLPQGYRMEQPRNCDDEVYELMRQCWRDRPYERPPFAQIALQLGRMLEARKAYVNMSLFENFTYAGIDATAEEA

SEQ ID NO: 251 - protein, 1382 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 252 - protein, 1382 aa, Homo sapiens; identical to SEQ ID NO: 251

SEQ ID NO: 253 - protein, 1344 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAIILIDEATASIDMETDTLIQRTIREAFQGCTVLVIAHRVTTVLNCDHILVMGNGKVVEFDRPEVLRKKPGSLFAALMATATSSLR

SEQ ID NO: 254 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 255 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 256 - protein, 230 aa, Homo sapiens
MTPEENAGTKLLLQGFESRFLVARTLRSFPWQSLEAKLRDSSDSELLQDILQKTVRHPVCVKHPPSVKYAWCFLSELIKKHEAVHTEPLDELYEALAETLMAKESPQGHRSYLLPSGGSVTLSESMAIISHSTTGLVTWDAALYIAEWAIENPAAFTHRSVLELGSGASLTGLAICKICRPRAYIFSDCHSRVLEQLQGNVLLNGLSLEADITANLDSPRVTMAQRWTGT

SEQ ID NO: 257 - protein, 654 aa, Homo sapiens
MCFRTKLSVSWVPLFLLLSRVFSTETDKPSAQDSRSRGSSGQPADLLQVLSAGDHPPHNHSRSLIKTLLEKTGCPRRRNGMQGDCNLCFEPDALLLIAGGNFEDQLREEVVQRVSLLLLYYIIHQEEICSSKLNMSNKEYKFYLHSLLSLRQDEDSSFLSQNETEDILAFTRQYFDTSQSQCMETKTLQKKSGIVSSEGANESTLPQLAAMIITLSLQGVCLGQGNLPSPDYFTEYIFSSLNRTNTLRLSELDQLLNTLWTRSTCIKNEKIHQFQRKQNNIITHDQGYSNFSSSMEKESEDGPVSWDQTCFSARQLVEIFLQKGLSLISKEDFKQMSPGIIQQLLSCSCHLPKDQQAKLPPTTLEKYGYSTVAVTLLTLGSMLGTALVLFHSCEENYRLILQLFVGLAVGTLSGDALLHLIPQVLGLHKQEAPEFGHFHESKGHIWKLMGLIGGIHGFFLIEKCFILLVSPNDKKSPEDSQAAEMPIGSMTASNRKCKAISLLAIMILVGDSLHNFADGLAIGAAFSSSSESGVTTTIAILCHEIPHEMGDFAVLLSSGLSMKTAILMNFISSLTAFMGLYIGLSVSADPCVQDWIFTVTAGMFLYLSLVEMLPEMTHVQTQRPWMMFLLQNFGLILGWLSLLLLAIYEQNIKI

SEQ ID NO: 258 - protein, 346 aa, Homo sapiens
MLFKQQAWLRQKLLVLGSLAVGSLLYLVARVGSLDRLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 259 - protein, 425 aa, Homo sapiens
MELRQCLSLKVQYLKKKGEQELVEVGDWILDWKLEKPSQRNCDIAQTLKNGWTGAKNRQVDQGAGESGRSIVQYSFKQEGVTPSVTSSGRTEVGSSYYSFSLDPVTFLCHIEYNLLQPICPIEGRLGGARTQAEFPLRALQFKRGLLHEFRKGNASKEQVRLHDLVQQLPKAIIIGVRKGGTRALLEMLNLHPAVVKASQEIHFFDNDENYGKGIEWYRKKMPFSYPQQITIEKSPAYFITEEVPERIYKMNSSIKLLIIVREPTTRAISDYTQVLEGKERKNKTYYKFEKLAIDPNTCEVNTKYKAVRTSIYTKHLERWLKYFPIEQFHVVDGDRLITEPLPELQLVEKFLNLPPRISQYNLYFNATRGFYCLRFNIIFNKCLAGSKGRIHPEVDPSVITKLRKFFHPFNQKFYQITGRTLNWP

SEQ ID NO: 260 - protein, 98 aa, Homo sapiens
MLSIYINIILAYTISLLGILTYRSHLIASLICLEGIILSLFIINTLITLNIHFTLAFIIPITLPVFAACKAAVGLALLVSISNTYGLDYVHNLNLLQC

SEQ ID NO: 261 - protein, 164 aa, Homo sapiens [sequence omitted]

SEQ ID NO: 262 - protein, 507 aa, Homo sapiens
MRRQGGGRGGLQAGSGSGASLGHGRDPVEGRTGQGSGGIRRPSSGFNPALAEVPGAGKGARRGGLYVGKGALKTTWGRSKGSGATLLSGSKVIAMAGKNFLFLGSPHLLPDNLVAVSRGRRGLGGGVATSGNFPKRKYKSGPAGRSRGGGVGGARFVPGIGMLGQEGSRVSGDQNHVQPGGGQPQGRGGWEGAGPGELGGGKLVLSFLSKSLCLVCGDVASGYHYGVSSCEDCKAFFKRTIQGSIKYSCPASNKCEIIKRRRKACQACRFTKCLRECAWIASGVGGRSTSGARGGPAALPGRLPCWAPGSRWRPPEDTPVNALVSHLLVVEPEKLYAMPDPMSVLQSVWMEVLVPGVAQRSLPLQDELAFTEDRVLDEEGARAAGLGELGTALLQLVRRLQSLRLERGEYVLLKALALANSDSVPIEDAEAVEQLPEAPHEALLEYEAGRAGTGGGAERRRPGRLLFTLPLLHQTAGKVLAHFYGVKLEGKVPMHKLFLEMLEAMMD

SEQ ID NO: 263 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 264 - protein, 257 aa, Homo sapiens; identical to SEQ ID NO: 263

SEQ ID NO: 265 - protein, 257 aa, Homo sapiens; identical to SEQ ID NO: 263

SEQ ID NO: 266 - protein, 257 aa, Homo sapiens; identical to SEQ ID NO: 263

SEQ ID NO: 267 - protein, 257 aa, Homo sapiens; identical to SEQ ID NO: 263

SEQ ID NO: 268 - protein, 257 aa, Homo sapiens; identical to SEQ ID NO: 263

SEQ ID NO: 269 - protein, 738 aa, Homo sapiens
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 270 - protein, 737 aa, Homo sapiens
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAASPKGASVSINVNTSLEDMRSNNVEDCKMMVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 271 - protein, 719 aa, Homo sapiens
MDLRRRDYHMERPLLNQEHLEELGRWGSAPRTHQWRTWLQCSRARAYALLLQHLPVLVWLPRYPVRDWLLGDLLSGLSVAIMQLPQGLAYALLAGLPPVFGLYSSFYPVFIYFLFGTSRHISVGTFAVMSVMVGSVTESLAPQALNDSMINETARDAARVQVASTLSVLVGLFQVGLGLIHFGFVVTYLSEPLVRGYTTAAAVQVFVSQLKYVFGLHLSSHSGPLSLIYTVLEVCWKLPQSKVGTVVTAAVAGVVLVVVKLLNDKLQQQLPMPIPGELLTLIGATGISYGMGLKHRFEVDVVGNIPAGLVPPVAPNTQLFSKLVGSAFTIAVVGFAIAISLGKIFALRHGYRVDSNQELVALGLSNLIGGIFQCFPVSCSMSRSLVQESTGGNSQVAGAISSLFILLIIVKLGELFHDLPKAVLAAIIIVNLKGMLRQLSDMRSLWKANRADLLIWLVTFTATILLNLDLGLVVAVIFSLLLVVVRTQMPHYSVLGQVPDTDIYRDVAEYSEAKEVRGVKVFRSSATVYFANAEFYSDALKQRCGVDVDFLISQKKKLLKKQEQLKLKQLQKEEKLRKQAGPLLSACLAPQQVSSGDKMEDATANGQEDSKAPDGSTLKALGLPQPDFHSLILDLGALSFVDTVCLKSLKNIFHDFREIEVEVYMAACHSPVVSQLEAGHFFDASITKKHLFASVHDAVTFALQHPRPVPDSPVSVTRL

SEQ ID NO: 272 - protein, 708 aa, Homo sapiens
MGMSKSHSFFGYPLSIFFIVVNEFCERFSYYGMRAILILYFTNFISWDDNLSTAIYHTFVALCYLTPILGALIADSWLGKFKTIVSLSIVYTIGQAVTSVSSINDLTDHNHDGTPDSLPVHVVLSLIGLALIALGTGGIKPCVSAFGGDQFEEGQEKQRNRFFSIFYLAINAGSLLSTIITPMLRVQQCGIHSKQACYPLAFGVPAALMAVALIVFVLGSGMYKKFKPQGNIMGKVAKCIGFAIKNRFRHRSKAFPKREHWLDWAKEKYDERLISQIKMVTRVMFLYIPLPMFWALFDQQGSRWTLQATTMSGKIGALEIQPDQMQTVNAILIVIMVPIFDAVLYPLIAKCGFNFTSLKKMAVGMVLASMAFVVAAIVQVEIDKTLPVFPKGNEVQIKVLNIGNNTMNISLPGEMVTLGPMSQTNAFMTFDVNKLTRINISSPGSPVTAVTDDFKQGQRHTLLVWAPNHYQVVKDGLNQKPEKGENGIRFVNTFNELITITMSGKVYANISSYNASTYQFFPSGIKGFTISSTEIPPQCQPNFNTFYLEFGSAYTYIVQRKNDSCPEVKVFEDISANTVNMALQIPQYFLLTCGEVVFSVTGLEFSYSQAPSNMKSVLQAGWLLTVAVGNIIVLIVAGAGQFSKQWAEYILFAALLLVVCVIFAIMARFYTYINPAEIEAQFDEDEKKNRLEKSNPYFMSGANSQKQM

SEQ ID NO: 273 - protein, 758 aa, Homo sapiens
MWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 274 - protein, 1888 aa, Homo sapiens
MGFLETPPQAAAIPDPWASPPLHSFAPSTDTTLERADQEVTSVLKRLLGPKAPGPSTGDLTGPGPCPRGAPALQETGSQPPVTGTSEAPAAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKVGAQVQVGEILGWPQELGGPREVGAVHTVHFPHIPPRLDTQQVSEALLSEGWGDGVPQSGLIAALPVLCLQDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKVRMSSPLHPRAWGLQARPISPRSHPLRARLSPTPNSPQQPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 275 - protein, 8550 aa, Homo sapiens
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTRFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQADAGEYSCEAGSQRLSFHLHVAEPKVVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVEGSWTRDGLRLQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRNIQIVRPLEDVEVMEKDGATFSCEVSHDEVPGQWFWEGSKLRPTDNVRIRQEGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHMGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKTAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQDGTRCELQIRGLSVADAGEYSCVCGQERTSATLTIRALPAKFTKGLRNEEATEGATAMLQCELSKVAPVEWRKGPETLRDGDRYNLRQDGTRCELQIHGLSVADTGEYSCVCGQEKTSATLTVKAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRRVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVRTSENAEVVFFENGLRHLLLLKNLRPQDSCRVTFLAGDMVTSAFLTVRGWRLEILEPLKNAAVRAGAQARFTCTLSEAVPVGEASWYINGAAVQPDDSDWTVTADGSHHALLLRSAQPHHAGEVTFACRDAVASAWLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVCLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLGRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDVQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLEALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEDTTLERADQEVTSVLKRLLGPKAPGPSTGDLTGPGPCPRGAPALQETGSQPPVTGTSEAPAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 276 - protein, 491 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHTFITSLSSVGIVVSDPDSTDASSIEDNEDICNTTSLENCTAK

SEQ ID NO: 277 - protein, 649 aa, Homo sapiens
MAPGEKIKAKIKKNLPVTGPQAPTIKELMRWYCLNTNTHGCRRIVVSRGRLRRLLWIGFTLTAVALILWQCALLVFSFYTVSVSIKVHFRKLDFPAVTICNINPYKYSTVRHLLADLEQETREALKSLYGFPESRKRREAESWNSVSEGKQPRFSHRIPLLIFDQDEKGKARDFFTGRKRKVGGSIIHKASNVMHIESKQVVGFQLCSNDTSDCATYTFSSGINAIQEWYKLHYMNIMAQVPLEKKINMSYSAEELLVTCFFDGVSCDARNFTLFHHPMHGNCYTFNNRENETILSTSMGGSEYGLQVILYINEEEYNPFLVSSTGAKVIIHRQDEYPFVEDVGTEIETAMVTSIGMHLTESFKLSEPYSQCTEDGSDVPIRNIYNAAYSLQICLHSCFQTKMVEKCGCAQYSQPLPPAANYCNYQQHPNWMYCYYQLHRAFVQEELGCQSVCKEACSFKEWTLTTSLAQWPSVVSEKWLLPVLTWDQGRQVNKKLNKTDLAKLLIFYKDLNQRSIMESPANSIEMLLSNFGGQLGLWMSCSVVCVIEIIEVFFIDFFSIIARRQWQKAKEWWAWKQAPPCPEAPRSPQGQDNPALDIDDDLPTFNSALHLPPALGTQVPGTPPPKYNTLRLERAFSNQLTDTQMLDEL

SEQ ID NO: 278 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRAMWLSLFSSEESNLGANNYDDYRMDWLVPATCEPIQSVFFFSGDKYYRVNLRTRRVDTVDPPYPRSIAQYWLGCPAPGHL

SEQ ID NO: 279 - protein, 165 aa, Homo sapiens [sequence omitted]

SEQ ID NO: 280 - protein, 1219 aa, Homo sapiens
MLRRVTVAAVCATRRKLCEAGRDVAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFLYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLAAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGSPSSEDSNSSCEVMQLTYLPTSPLLADCIIPITDIRAFTTTLNLLPYHKIVK

SEQ ID NO: 281 - protein, 477 aa, Homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 282 - protein, 340 aa, Homo sapiens
MSGEPELIELRELAPAGRAGKGRTRLERANALRIARGTACNPTRQLVPGRGHRFQPAGPATHTWCDLCGDFIWGVVRKGLQCAHCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 283 - protein, 189 aa, Homo sapiens
MSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 284 - protein, 270 aa, Homo sapiens
MGEAEAPSFEMTWSSTTSSGYCSQEDSDSELEQYFTARTSLARRPRRDQDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 285 - protein, 344 aa, Homo sapiens
MSGEPELIELRELAPAGRAGKGRTRLERANALRIARGTACNPTRQLVPGRGHRFQPAGPATHTWCDLCGDFIWGVVRKGLQCARLSADCKFTCHYRCRALVCLDCCGPRDLGWEPAVERDTNVDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 286 - protein, 344 aa, Homo sapiens
MSGEPELIELRELAPAGRAGKGRTRLERANALRIARGTACNPTRQLVPGRGHRFQPAGPATHTWCDLCGDFIWGVVRKGLQCAHCKFTCHYRCRALVCLDCCGPRDLGWEPAVERDTNVPILQDEPVEWETPDLSQAEIEQKIKEYNAQINSNLFMSLNKDGSYTGFIKVQLKLVRPVSVPSSKKPPSLQDARRGPGRGTSVRRRTSFYLPKDAVKHLHVLSRTRAREVIEALLRKFLVVDDPRKFALFERAERHGQVYLRKLLDDEQPLRLRLLAGPSDKALSFVLKENDSGEVNWDAFSMPELHNFLRILQREEEEHLRQILQKYSYCRQKIQEALHACPLG

SEQ ID NO: 287 - protein, 92 aa, Homo sapiens
MSGEPELIELRELAPAGRAGKGRTRLERANALRIARGTACNPTRQLVPGRGHRFQPAGPATHTWCDLCGDFIWGVVRKGLQCARRACGVGDT

SEQ ID NO: 288 - protein, 152 aa, Homo sapiens
MSGEPELIELRELAPAGRAGKGRTRLERANALRIARGTACNPTRQLVPGRGHRFQPAGPATHTWCDLCGDFIWGVVRKGLQCAQQGRFLHRLHQGSAEAGAPCLCALQQEATLLAGCPAGPRTGHKCQAPHFLLPAQGCCQAPACAVTHKGT

SEQ ID NO: 289 - protein, 605 aa, Homo sapiens
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKFYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 290 - protein, 323 aa, Homo sapiens
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 291 - protein, 1358 aa, Homo sapiens
MGNQLAGIAPSQILSVESYFSDIHDFEYDKSLGSTRFFKVARAKHREGLVVVKVFAIQDPTLPLTSYKQELEELKIRLNSAQNCLPFQKASEKASEKAAMLFRQYVRDNLYDRISTRPFLNNIEKRWIAFQILTAVDQAHKSGVRHGDIKTENVMVTSWNWVLLTDFASFKPTYLPEDNPADFNYFFDTSRRRTCYIAPERFVDGGMFATELEYMRDPSTPLVDLNSNQRTRGELKRAMDIFSAGCVIAELFTEGVPLFDLSQLLAYRNGHFFPEQVLNKIEDHSIRELVTQMIHREPDKRLEAEDYLKQQRGNAFPEIFYTFLQPYMAQFAKETFLSADERILVIRKDLGNIIHNLCGHDLPEKAEGEPKENGLVILVSVITSCLQTLKYCDSKLAALELILHLAPRLSVEILLDRITPYLLHFSNDSVPRVRAEALRTLTKVLALVKEVPRNDINIYPEYILPGIAHLAQDDATIVRLAYAENIALLAETALRFLELVQLKNLNMENDPNNEEIDEVTHPNGNYDTELQALHEMVQQKVVTLLSDPENIVKQTLMENGITRLCVFFGRQKANDVLLSHMITFLNDKNDWHLRGAFFDSIVGVAAYVGWQSSSILKPLLQQGLSDAEEFVIVKALYALTCMCQLGLLQKPHVYEFASDIAPFLCHPNLWIRYGAVGFITVVARQISTADVYCKLMPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMMKSNKAKANIVDQSHLHDSSQKGVIDLAALGITGRQVDLVKTKQEPDDKRARKHVKQDSNVNEEWKSMFGSLDPPNMPQALPKGSDQEVIQTGKPPRSESSAGICVPLSTSSQVPEVTTVQNKKPVIPVLSSTILPSTYQIRITTCKTELQQLIQQKREQCNAERIAKQMMENAEWESKPPPPGWRPKGLLVAHLHEHKSAVNRIRVSDEHSLFATCSNDGTVKIWNSQKMEGKTTTTRSILTYSRIGGRVKTLTFCQGSHYLAIASDNGAVQLLGIEASKLPKSPKIHPLQSRILDQKEDGCVVDMHHFNSGAQSVLAYATVNGSLVGWDLRSSSNAWTLKHDLKSGLITSFAVDIHQCWLCIGTSSGTMACWDMRFQLPISSHCHPSRARIRRLSMHPLYQSWVIAAVQGNNEVSMWDMETGDRRFTLWASSAPPLSELQPSPHSVHGIYCSPADGNPILLTAGSDMKIRFWDLAYPERSYVVAGSTSSPSVSYYRKIIEGTEVVQEIQNKQKVGPSDDTPRRGPESLPVGHHDIITDVATFQTTQGFIVTASRDGIVKVWK

SEQ ID NO: 292 - protein, 2022 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKKNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 293 - protein, 218 aa, Homo sapiens [sequence omitted]

SEQ ID NO: 294 - protein, 392 aa, Homo sapiens
MSTRESFNPESYELDKSFRLTRFTELKGTGCKVPQDVLQKLLESLQENHFQEDEQFLGAVMPRLGIGMDTCVIPLRHGGLSLVQTTDYIYPIVDDPYMMGRIACANVLSDLYAMGVTECDNMLMLLGVSNKMTDRERDKVMPLIIQGFKDAAEEAGTSVTGGQTVLNPWIVLGGVATTVCQPNEFIMPDNAVPGDVLVLTKPLGTQVAVAVHQWLDIPEKWNKIKLVVTQEDVELAYQEAMMNMARLNRTAAGLMHTFNAHAATDITGFGILGHAQNLAKQQRNEVSFVIHNLPVLAKMAAVSKACGNMFGLMHGTCPETSGGLLICLPREQAARFCAEIKSPKYGEGHQAWIIGIVEKGNRTARIIDKPRIIEVAPQVATQNVNPTPGATS

SEQ ID NO: 295 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 296 - protein, 417 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 297 - protein, 426 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGVFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 298 - protein, 380 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQNEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 299 - protein, 372 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQMFWVQVLLAGLVVPLLLGATLTYTYRHCWPHKPLVTADEAGMEALTPPPATHLSPLDSAHTLLAPPDSSEKICTVQLVGNSWTPGYPETQEALCPQVTWSWDQLPSRALGPAAAPTLSPESPAGSPAMMLQPGPQLYDVMDAVPARRWKEFVRTLGLREAEIEAVEVEIGRFRDQQYEMLKRWRQQQPAGLGAVYAALERMGLDGCVEDLRSRLQRGP

SEQ ID NO: 300 - protein, 277 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTPPPSLAGAPWGAVQSAVPLSVAGGRVGGVLGMRVGELGWTEGRRVRRGATTQHPPAAFSVLGPGAPGWPCGPPPAWGHPDLHIPPLLASQAPGYCR

SEQ ID NO: 301 - protein, 253 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTSTLGSCPERCAAVCGWRQSRWCAGNASGRTGMDRGEAGEEGGNHPTPTSCFQCSGSRCSWLALWSPSCLGPP

SEQ ID NO: 302 - protein, 218 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPTVLGPGAPGWPCGPPPAWGHPDLHIPPLLASQAPGYCR

SEQ ID NO: 303 - protein, 181 aa, Homo sapiens
MEQRPRGCAAVAAALLLVLLGARAQGGTRSPRCDCAGDFHKKIGLFCCRGCPAGHYLKAPCTEPCGNSTCLVCPQDTFLAWENHHNSECARCQACDEQASQVALENCSAVADTRCGCKPGWFVECQVSQCVSSSPFYCQPCLDCGALHRHTRLLCSRRDTDCGTCLPGFYEHGDGCVSCPT

SEQ ID NO: 304 - protein, 136 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCSRRDTDCGTCLPGFYEHGDGCVSCPT

SEQ ID NO: 305 - protein, 126 aa, Homo sapiens
MEQRPRGCAAVAAALLLVLLGARAQGGTRSPRCDCAGDFHKKIGLFCCRGCPAASQVALENCSAVADTRCGCKPGWFVECQVSQCVSSSPFYCQPCLDCGALHRHTRLLCHPSVTLGQRPHPSSTS

SEQ ID NO: 306 - protein, 712 aa, Homo sapiens
MLAMDTCKHVGQLQLAQDHSSLNPQKWHCVDCNTTESIWACLSCSHVACGRYIEEHALKHFQESSHPVALEVNEMYVFCYLCDDYVLNDNATGDLKLLRRTLSAIKSQNYHCTTRSGRFLRSMGTGDDSYFLHDGAQSLLQSEDQLYTALWHRRRILMGKIFRTWFEQSPIGRKKQEEPFQEKIVVKREVKKRRQELEYQVKAELESMPPRKSLRLQGLAQSTIIEIVSVQVPAQTPASPAKDKVLSTSENEISQKVSDSSVKRRPIVTPGVTGLRNLGNTCYMNSVLQVLSHLLIFRQCFLKLDLNQWLAMTASEKTRSCKHPPVTDTVVYQMNECQEKDTGFVCSRQSSLSSGLSGGASKGRKMELIQPKEPTSQYISLCHELHTLFQVMWSGKWALVSPFAMLHSVWRLIPAFRGYAQQDAQEFLCELLDKIQRELETTGTSLPALIPTSQRKLIKQVLNVVNNIFHGQLLSQVTCLACDNKSNTIEPFWDLSLEFPERYQCSGKDIASQPCLVTEMLAKFTETEALEGKIYVCDQCNSKRRRFSSKPVVLTEAQKQLMICHLPQVLRLHLKRFRWSGRNNREKIGVHVGFEEILNMEPYCCRETLKSLRPECFIYDLSAVVMHHGKGFGSGHYTAYCYNSEGGFWVHCNDSKLSMCTMDEVCKAQAYILFYTQRVTENGHSKLLPPELLLGSQHPNEDADTSSNEILS

SEQ ID NO: 307 - protein, 496 aa, Homo sapiens [sequence omitted]

SEQ ID NO: 308 - protein, 496 aa, Homo sapiens [sequence omitted]

SEQ ID NO: 309 - protein, 448 aa, Homo sapiens
MDRMKKIKRQLSMTLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEF

SEQ ID NO: 310 - DNA, 12 bp, Artificial Sequence
  Synthetic oligonucleotide
gtttgctataac

SEQ ID NO: 311 - DNA, 21 bp, Artificial Sequence
  Synthetic oligonucleotide
ccgtttacgtggagactcgcc

SEQ ID NO: 312 - DNA, 25 bp, Artificial Sequence
  Synthetic oligonucleotide
cccccaccttatatatattctttcc

SEQ ID NO: 313 - DNA, 21 bp, Artificial Sequence
  Synthetic oligonucleotide
ttccagaccattggcttgagt

SEQ ID NO: 314 - DNA, 21 bp, Artificial Sequence
  Synthetic oligonucleotide
actcccactgactttcctgct

SEQ ID NO: 315 - DNA, 25 bp, Artificial Sequence
  Synthetic oligonucleotide
catgctgagtgacacagacaagaag

SEQ ID NO: 316 - DNA, 25 bp, Artificial Sequence
  Synthetic oligonucleotide
tggtagttgttgtgagcatagtcca

The invention claimed is:

1. An agent for inducing the differentiation of undifferentiated mammalian cells into osteoblasts, wherein said agent consists of (1) a targeting nucleic acid sequence consisting of a sequence that is complementary to a nucleic acid sequence in said undifferentiated mammalian cells and that is selected from the group consisting of of SEQ ID NO: 72, and (2) one or more other nucleic acid sequences that are not complementary to said nucleic acid sequence in said undifferentiated mammalian cells.

2. A vector comprising the agent according to claim 1, wherein said vector is capable of expressing said agent in a mammalian cell.

3. The vector according to claim 2, which is an adenoviral, retroviral, adeno-associated viral, lentiviral, a herpes simplex viral or a sendaiviral vector.

4. The agent according to claim 1, wherein a first sequence of said other nucleic acid sequences that are not complementary to said nucleic acid sequence in said undifferentiated mammalian cells is complementary to said targeting nucleotide sequence.

5. The agent according to claim 4, wherein a second sequence of said other nucleic acid sequences that are not complementary to said nucleic acid sequence in said undifferentiated mammalian cells consists of a loop region connecting said targeting nucleotide sequence and said first sequence of other nucleic acid sequences complementary to said targeting nucleic acid sequence.

6. The agent according to claim 5, wherein said loop region comprises a nucleic acid sequence of SEQ ID NO: 310.

7. A bone formation enhancing pharmaceutical composition comprising a therapeutically effective amount of an agent of claim 1 in admixture with a pharmaceutically acceptable carrier.

8. A vector comprising the agent according to claim 6, wherein said vector is capable of expressing said agent in a mammalian cell.

9. The vector according to claim 8, wherein said vector is an adenoviral vector and said targeting nucleic acid sequence consists of SEQ ID NO:72.

10. A bone formation enhancing pharmaceutical composition comprising a therapeutically effective amount of an agent of claim 9 in admixture with a pharmaceutically acceptable carrier.

* * * * *